(12) United States Patent
Bhanot et al.

(10) Patent No.: US 8,362,232 B2
(45) Date of Patent: Jan. 29, 2013

(54) COMPOUNDS AND METHODS FOR MODULATING EXPRESSION OF SGLT2

(75) Inventors: Sanjay Bhanot, Carlsbad, CA (US); Richard S. Geary, Carlsbad, CA (US); Robert McKay, Poway, CA (US); Brett P. Monia, Carlsbad, CA (US); Punit P. Seth, Carlsbad, CA (US); Andrew M. Siwkowski, Carlsbad, CA (US); Eric E. Swayze, Carlsbad, CA (US); Edward Wancewicz, Carlsbad, CA (US)

(73) Assignee: Isis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 12/883,049

(22) Filed: Sep. 15, 2010

(65) Prior Publication Data

US 2011/0065775 A1    Mar. 17, 2011

Related U.S. Application Data

(63) Continuation of application No. 12/299,611, filed as application No. PCT/US2007/068406 on May 7, 2007, and a continuation-in-part of application No. PCT/US2007/061183, filed on Jan. 27, 2007.

(60) Provisional
(Continued)

(51) Int. Cl.
*C07H 21/04* (2006.01)

(52) U.S. Cl. .................. 536/24.5; 536/24.31; 536/24.1; 514/44

(58) Field of Classification Search .................. None
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,458,066 A | 7/1984 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,668,777 A | 5/1987 | Caruthers et al. |
| 4,725,677 A | 2/1988 | Koster et al. |
| 4,845,205 A | 7/1989 | Huynh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,069 E | 9/1992 | Koster et al. |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,185,444 A | 2/1993 | Summerton et al. |
| 5,188,897 A | 2/1993 | Suhadolnik et al. |
| 5,194,599 A | 3/1993 | Froehler |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,276,019 A | 1/1994 | Cohen et al. |
| 5,278,302 A | 1/1994 | Caruthers et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |

(Continued)

FOREIGN PATENT DOCUMENTS

| | | |
|---|---|---|
| WO | WO 94/02499 | 2/1994 |
| WO | WO 94/17093 | 8/1994 |

(Continued)

OTHER PUBLICATIONS

Abifadel et al., "Mutations in PCSK9 cause autosomal dominant hypercholesterolemia" Nat. Genet. (2003) 34:154-156. Agrawal et al., Molecular Med. Today (2000) 6:72-81.
Al-Chalabi et al., "Recent advances in amyotrophic lateral sclerosis" Curr. Opin. Neurol. (2000) 13:397-405.
Alisky et al., "Gene therapy for amyotrophic lateral schlerosis and othe rmotor neuron disease" Hum. Gene Ther. (2000) 11:2315-2329.
Bamberger et al., "Glucocorticoid receptor beta, a potential endogenous inhibitor of glucocorticoid action in humans" J. Clin. Invest. (1995) 95:2435-2441.

(Continued)

*Primary Examiner* — Kimberly Chong
(74) *Attorney, Agent, or Firm* — Knobbe Martens

(57) ABSTRACT

The present disclosure describes short antisense compounds, including such compounds comprising chemically-modified high-affinity monomers 8-16 monomers in length. Certain such short antisense compound are useful for the reduction of target nucleic acids and/or proteins in cells, tissues, and animals with increased potency and improved therapeutic index. Thus, provided herein are short antisense compounds comprising high-affinity nucleotide modifications useful for reducing a target RNA in vivo. Such short antisense compounds are effective at lower doses than previously described antisense compounds, allowing for a reduction in toxicity and cost of treatment. In addition, the described short antisense compounds have greater potential for oral dosing.

46 Claims, No Drawings

Related U.S. Application Data application No. 60/746,631, filed on May 5, 2006, provisional application No. 60/864,554, filed on Nov. 6, 2006, provisional application No. 60/805,660, filed on Jun. 23, 2006, provisional application No. 60/747,059, filed on May 11, 2006.

(56) References Cited

U.S. PATENT DOCUMENTS

| | | |
|---|---|---|
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,459,255 A | 10/1995 | Cook et al. |
| 5,466,677 A | 11/1995 | Baxter et al. |
| 5,466,786 A | 11/1995 | Buhr et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Misiura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,607,922 A | 3/1997 | De Clercq et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bischofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,658,873 A | 8/1997 | Bertsch-Frank et al. |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,747 A | 8/1998 | Schally et al. |
| 5,801,154 A | 9/1998 | Baracchini et al. |
| 5,830,653 A | 11/1998 | Froehler et al. |
| 5,998,148 A | 12/1999 | Bennett et al. |
| 6,005,096 A | 12/1999 | Matteucci et al. |
| 6,043,060 A | 3/2000 | Imanishi |
| 6,133,246 A | 10/2000 | McKay et al. |
| 6,268,490 B1 | 7/2001 | Imanishi et al. |
| 6,426,220 B1 | 7/2002 | Bennett et al. |
| 6,436,640 B1 | 8/2002 | Simmons et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,670,461 B1 | 12/2003 | Wengel et al. |
| 6,770,748 B2 | 8/2004 | Imanishi et al. |
| 6,794,499 B2 | 9/2004 | Wengel et al. |
| 6,964,950 B2 | 11/2005 | Crooke et al. |
| 7,034,133 B2 | 4/2006 | Wengel et al. |
| 7,053,207 B2 | 5/2006 | Wengel |
| 7,084,125 B2 | 8/2006 | Wengel |
| 7,217,805 B2 | 5/2007 | Imanishi et al. |
| 7,271,156 B2 * | 9/2007 | Krieg et al. ............... 514/44 A |
| 7,314,923 B2 | 1/2008 | Kaneko et al. |
| 7,399,845 B2 | 7/2008 | Seth et al. |
| 7,427,672 B2 | 9/2008 | Imanishi et al. |
| 7,511,131 B2 | 3/2009 | Crooke et al. |
| 2001/0021772 A1 | 9/2001 | Uhlmann et al. |
| 2001/0053519 A1 | 12/2001 | Fodor et al. |
| 2003/0082807 A1 | 5/2003 | Wengel |
| 2003/0087230 A1 | 5/2003 | Wengel |
| 2003/0105309 A1 | 6/2003 | Imanishi |
| 2003/0199467 A1 | 10/2003 | Roberts et al. |
| 2003/0207841 A1 | 11/2003 | Kaneko et al. |
| 2003/0212026 A1* | 11/2003 | Krieg et al. ............... 514/44 |
| 2003/0224377 A1 | 12/2003 | Wengel et al. |
| 2003/0228597 A1 | 12/2003 | Cowsert et al. |
| 2004/0014959 A1 | 1/2004 | Sorensen et al. |
| 2004/0096848 A1 | 5/2004 | Thrue et al. |
| 2004/0143114 A1 | 7/2004 | Imanishi et al. |
| 2004/0162249 A1 | 8/2004 | Liang et al. |
| 2004/0171570 A1 | 9/2004 | Allerson et al. |
| 2004/0192918 A1 | 9/2004 | Imanishi et al. |
| 2004/0219565 A1 | 11/2004 | Kauppinen et al. |
| 2005/0107325 A1 | 5/2005 | Manoharan et al. |
| 2005/0191653 A1 | 9/2005 | Freier et al. |
| 2005/0203042 A1 | 9/2005 | Frieden |
| 2006/0128646 A1 | 6/2006 | Christensen et al. |
| 2007/0049542 A1 | 3/2007 | Gellet et al. |
| 2007/0238866 A1 | 10/2007 | Deshpande et al. |

FOREIGN PATENT DOCUMENTS

| | | |
|---|---|---|
| WO | WO 94/22890 | 10/1994 |
| WO | WO 98/39352 | 9/1998 |
| WO | WO 99/14226 | 3/1999 |
| WO | WO 02/36743 | 5/2002 |
| WO | WO 2005/038013 | 4/2005 |
| WO | WO 2005/042552 | 5/2005 |
| WO | WO 2005/012371 | 12/2005 |
| WO | WO 2005/012372 | 12/2005 |
| WO | WO 2005/121371 | 12/2005 |
| WO | WO 2007090071 | 8/2007 |

OTHER PUBLICATIONS

Belikova et al., "Synthesis of ribonucleosides and diribonucleoside phosphates containing 2-chloroethylamine and nitrogen mustard residues." Tetrahedron Lett. (1967) 37:3557-3562.

Bennett et al., "Antisense oligonucleotides as a tool for gene functionalization and target validation" Biochimica at Biophysica Acta (1999) 1489:19-30.

Berger et al., "Universal bases for hybridization, replication and chain termination" Nucleic Acids Res. (2000) 28:2911-2914.

Braasch et al., "Locked nucleic acid (LNA): fine-tuning the recognition of DNA and RNA" Chem. Biol. (2001) 8:1-7.
Branch et al., "A good antisense molecule is hard to find," TIBS (1998)23:45-50.
Bray et al., "Variations of the human glucocorticoid receptor gene (NR3C1): pathological and in vitro mutations and polymorphisms" Hum. Mutat. (2003) 21:557-568.
Breslin et al., "Multiple promoters exist in the human GR gene, on of which is activated by glucocorticoids" Mol. Endocrinol. (2001) 15:1381-1395.
Buhman et al., "DGAT1 is not essential for intestinal triacylglycerol absorption or chylomicron synthesis" J. Biol. Chem. (2002) 277:25474-25479.
Bunn et al., "The glycosylation of hemoglobin: relevance to diabetes mellitus" Science (1978) 200:21-27.
Cases et al., "Identification of a gene encoding an acyl CoA:diacylglycerol acyltransferase, a key enzyme in triacylglycerol synthesis." Proc Natl Acad Sci USA (1998) 95:13018-13023.
Cases et al., "Cloning of DGAT2, a second mammalian diacylglycerol acyltransferase, and related family members." J. Biol. Chem. (2001) 276(42):38870-38876.
Chambers. "Glucagon receptor gene mutation in essential hypertension." Nat. Genet. (1996) 12(2):122.
Chen et al., "Protein-tyrosine phosphatases PTP1B and syp are modulators of insulin-stimulated translocation of GLUT4 in transfected rat adipose cells." J. Biol. Chem. (1997) 272(12):8026-8031.
Chen et al., "Increased insulin and leptin sensitivity in mice lacking acyl CoA:diacylglycerol acyltransferase 1." J. Clin. Invest. (2002) 109(8):1049-1055.
Chen et al., "Leptin modulates the effects of acyl CoA:diacylglycerol acyltransferase deficiency on murine fur and sebaceous glands." J. Clin. Invest. (2002) 109(2):175-181.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Chirila et al., Biomaterials (2002) 23:321-342.
Chrousos, "The hypothalamic-pituitary-adrenal axis and immune-mediated inflammation." N. Engl. J. Med. (1995) 332(20):1351-1362.
Cleveland et al., "Oxidation versus aggregation—how do SOD1 mutants cause ALS?" Nat. Med. (2000) 6(12):1320-1321.
Crooke et al., "Pharmacokinetic properties of several novel oligonucleotide analogs in mice." J. Pharmacol. Exp. Ther. (1996) 277(2):923-937.
Crooke et al., "Basic Principles of Antisense Therapeutics" Antisense Research and Application (1998) Chapter 1:1-50.
Crooke, Ann. Rev. Medicine (2004) 55:61-95.
Davidson, "Apolipoprotein B: mRNA editing, lipoprotein assembly, and presecretory degradation." Annu. Rev. Nutr. (2000) 20:169-193.
Elayadi et al., "Application of PNA and LNA oligomers to chemotherapy" Curr. Opinion Invest. Drugs (2001) 2:558-561.
Elchebly et al., "Increased insulin sensitivity and obesity resistance in mice lacking the protein tyrosine phosphatase-1B gene." Science (1999) 283(5407):1544-1548.
Encio et al., "The genomic structure of the human glucocorticoid receptor." J. Biol. Chem. (1991) 266(11):7182-7188.
Engelmann et al., "Downregulation of brain mineralocorticoid and glucocorticoid receptor by antisense oligodeoxynucleotide treatment fails to alter spatial navigation in rats." Eur. J. Pharmacol. (1998) 361(1):17-26.
Expert Panel on Detection, Evaluation, and Treatment of High Blood Cholesterol in Adults "Executive Summary of the Third Report of the National Cholesterol Education Program (NCEP) Expert Panel on Detection, Evaluation, and Treatment of High Blood Cholesterol in Adults (Adult Treatment Panel III)" JAMA (2001) 285:2486-2497.
Farese et al., "Triglyceride synthesis: insights from the cloning of diacylglycerol acyltransferase." Curr. Opin. Lipidol. (2000) 11(3):229-234.

Freier et al., "The ups and downs of nucleic acid duplex stability: structure-stability studies on chemically-modified DNA:RNA duplexes." Nucleic Acids Research (1997) 25(22):4429-4443.
Fridovich, "Superoxide radical and superoxide dismutases." Annu. Rev. Biochem. (1995) 64:97-112.
Frieden et al., "Expanding the design horizon of antisense oligonucleotides with alpha-L-LNA." Nucleic Acids Research (2003) 31(21):6365-6372.
Friedman et al., "Phosphoenolpyruvate carboxykinase (GTP) gene transcription and hyperglycemia are regulated by glucocorticoids in genetically obese db/db transgenic mice." J. Biol. Chem. (1997) 272(50):31475-31481.
Fujisawa et al., "A mutation in the glucagon receptor gene (Gly40Ser): heterogeneity in the association with diabetes mellitus." Diabetologia (1995) 38:983-985.
Gait, "Applications of Chemically synthesized RNA" RNA: Protein Interactions, Ed. Smith (1998) pp. 1-36.
Gallo et al., "2'-C-Methyluridine phosphoramidite: a new building block for the preparation of RNA analogues carrying the 2'-hydroxyl group." Tetrahedron (2001) 57(27):5707-5713.
Geary et al., "Pharmacokinetics of phosphorothioate antisense oligodeoxynucleotides." Curr. Opin. Investig. Drugs (2001) 2(4):562-573.
Gehring et al., "Assignment of the human gene for the glucocorticoid receptor to chromosome 5." PNAS (1985) 82(11):3751-3755.
Gettys et al., "RU-486 (Mifepristone) ameliorates diabetes but does not correct deficient beta-adrenergic signalling in adipocytes from mature C57BL/6J-ob/ob mice." Int. J. Obes. Relat. Metab. Disord. (1997) 21(10):865-873.
Goldstein et al., "Regulation of the insulin signalling pathway by cellular protein-tyrosine phosphatases." Mol. Cell. Biochem. (1998) 182(1-2):91-99.
Graham et al., "Pharmacological Inhibition of PCSK9 in Hyperlipidemic Mice Significantly Reduces Serum LDL-C While Increasing Hepatic Low-Density Lipoprotein Receptor Protein Abundance" (2007) 27(6): p. E36.
Grundy et al., "Implications of recent clinical trials for the National Cholesterol Education Program Adult Treatment Panel III guidelines." Circulation (2004) 110(2):227-239.
Handlon, "Sodium glucose co-transporter 2 (SGLT2) inhibitors as potential antidiabetic agents" Expert Opin. Ther. Patents (2005) 15(11):1531-1540.
Herbert et al., "Lipid modification of GRN163, and N3'->P5' thiophosphoramidate oligonucleotide, enhances the potency of telomerase inhibition" Oncogene (2005) 1-7.
Hollenberg et al., "Primary structure and expression of a functional human glucocorticoid receptor cDNA." Nature (1985) 318(6047):635-641.
Kabanov et al., "A new class of antivirals: antisense oligonucleotides combined with a hydrophobic substituent effectively inhibit influenza virus reproduction and synthesis of virus-specific proteins in MDCK cells." FEBS Lett. (1990) 259(2):327-330.
Kanai et al., "The human kidney low affinity Na+/glucose cotransporter SGLT2. Delineation of the major renal reabsorptive mechanism for D-glucose." J. Clin. Invest. (1994) 93(1):397-404.
Khatsenko et al., "Absorption of Antisense Oligonucleotides in Rat Intestine: Effect of Chemistry and Length" Antisense & Nucleic Acid Drug Development (2000) 10:35-44.
Korte et al., "Antisense to the glucocorticoid receptor in hippocampal dentate gyrus reduces immobility in forced swim test" Eur. J. Pharmacol. (1996) 301(1-3):19-25.
Koshkin et al., "LNA (Locked Nucleic Acids): Synthesis of the adenine, cytosine, guanine, 5-methylcytosine, thymine and uracil bicyclonucleoside monomers, oligomerisation, and unprecedented nucleic acid recognition" Tetrahedron (1998) 54(14):3607-3630.
Kumar et al., "The first analogues of LNA (locked nucleic acids): phosphorothioate-LNA and 2'-thio-LNA." Bioorg. Med. Chem. Lett. (1998) 8(16):2219-2222.
Kurreck, "Antisense Technologies—Improvement through novel chemical modifications" Eur. J. Biochem. (2003) 270:1628-1644.
Lambert et al., "PCSK9: un nouveau gene implique dans l'hypercholesterolemia familiale" M/S Medicine Sciences, Scoiete des Periodiques Flammarion, Paris France (2004) 20(12):1068-1070 (in French).
Lardizabal et al., "DGAT2 is a new diacylglycerol acyltransferase gene family: purification, cloning, and expression in insect cells of two polypeptides from Mortierella ramanniana with diacylglycerol acyltransferase activity." J. Biol. Chem. (2001) 276(42):38862-38869.

Lazowski, "Short, 12 mer fluorescently labeled methylphosphonated oligonucleotides to visualize beta-actin mRNA in vivo." Journal of physiology and pharmacology (2003) http://jpp.krakow.pl/journal/archive/1203/articles/12_article.html.

Letsinger et al., "Cholesteryl-conjugated oligonucleotides: synthesis, properties, and activity as inhibitors of replication of human immunodeficiency virus in cell culture." PNAS (1989) 86(17):6553-6556.

Leung et al., "Association of glucocorticoid insensitivity with increased expression of glucocorticoid receptor beta." J. Exp. Med. (1997) 186(9):1567-1574.

Link, "Pharmacological regulation of hepatic glucose production." Curr. Opin. Investig. Drugs (2003) 4(4):421-429.

Lok et al., "The human glucagon receptor encoding gene: structure, cDNA sequence and chromosomal localization." Gene (1994) 140(2):203-209.

MacNeil et al., "Cloning and expression of a human glucagon receptor." Biochem. Biophys. Res. Commun. (1994) 198(1):328-334.

Madsen et al., "Advances in non-peptide glucagon receptor antagonists." Curr. Pharm. Des. (1999) 5(9):683-691.

Maget et al., "Sequencing of eleven introns in genomic DNA encoding rat glucagon receptor and multiple alternative splicing of its mRNA." FEBS Lett. (1994) 351(2):271-275.

Manoharan et al., "Chemical modifications to improve uptake and bioavailability of antisense oligonucleotides." Ann. N.Y. Acad. Sci. (1992) 660:306-309.

Manoharan et al., "Introduction of a lipophilic thioether tether in the minor groove of nucleic acids for antisense applications" Bioorg. Med. Chem. Lett. (1993) 3:2765-2770.

Manoharan et al., "Cholic acid-oligonucleotide conjugates for antisense applications" Bioorg. Med. Chem. Lett. (1994) 4(8):1053-1060.

Manoharan et al., "Lipidic nucleic acids " Tetrahedron Lett. (1995) 36(21):3651-3654.

Manoharan Et al., "Oligonucleotide Conjugates: Alteration of the Pharmacokinetic Properties of Antisense Agents " Nucleosides & Nucleotides (1995) 14(3-5):969-973.

Maxwell et al., "Proprotein convertase subtilisin kexin 9: the third locus implicated in autosomal dominant hypercholesterolemia" Current Opinion in Lipidology (2005) 16(2):167-172.

Menzel et al., "Localization of the glucagon receptor gene to human chromosome band 17q25." Genomics (1994) 20(2):327-328.

Mishra et al., "Improved leishmanicidal effect of phosphorotioate antisense oligonucleotides by LDL-mediated delivery." Biochim. Biophys. Acta (1995) 1264(2):229-237.

Monia et al., "Evaluation of 2'-Modified Oligonucleotides Containing 2'-Deoxy Gaps as Antisense Inhibitors of Gene Expression" Journal of Biological Chemistry (1993) 268(19):14514-14522.

Monia et al., "Selective Inhibition of Mutant Ha-ras mRNA Expression by Antisense Oligonucleotides" J. Biol. Chem. (1992) 267(28):19954-19962.

Morita et al., "Synthesis and properties of 2'-O,4'-C-ethylene-bridged nucleic acids (ENA) as effective antisense oligonucleotides." Bioorganic Medicinal Chemistry (2003) 11(10):2211-2226.

Nawano et al., "Hyperglycemia contributes insulin resistance in hepatic and adipose tissue but not skeletal muscle of ZDF rats." Am. J. Physiol. Endocrinol. Metab. (2000) 278(3):E535-543.

New England Biolabs 1998/99 Catalog (cover page and pp. 121 and 284).

Oakley et al., "The human glucocorticoid receptor beta isoform. Expression, biochemical properties, and putative function." J. Biol. Chem. (1996) 271(16):9550-9559.

Oberhauser et al., "Effective incorporation of 2'-O-methyl-oligoribonucleotides into liposomes and enhanced cell association through modification with thiocholesterol." Nucl. Acids Res. (1992) 20(3):533-538.

Oelkers et al., "Characterization of two human genes encoding acyl coenzyme A:cholesterol acyltransferase-related enzymes." J. Biol. Chem. (1998) 273(41):26765-26771.

Opalinska et al., Nature Rev. (2002) 1:503-514.

Orum et al., "Locked nucleic acids: a promising molecular family for gene-function analysis and antisense drug development." Curr. Opinion Mol. Ther. (2001) 3(3):239-243.

Pepin et al., "Decreased glucocorticoid receptor activity following glucocorticoid receptor antisense RNA gene fragment transfection." Mol. Cell Biol. (1991) 11(3):1647-1653.

Peracchi et al., Rev. Med. Virol. (2004) 14:47-64.

Pujols et al., "Expression of glucocorticoid receptor alpha- and beta-isoforms in human cells and tissues." Am. J. Physiol. Cell Physiol. (2002) 283(4):C1324-1331.

Rashid et al., "Decreased plasma cholesterol and hypersensitivity to statins in mice lacking Pcsk9" Proc. Natl. Acad. Sci. U.S.A. (2005) 102(15):5374-5379.

Reynolds et al., "Rational siRNA design for RNA interference" Nature Biotechnology (2004) 22(3):326-330.

Richard et al., "Energy balance and lipid metabolism in transgenic mice bearing an antisense GCR gene construct." Am. J. Physiol. (1993) 265:R146-R150.

Rosmond, "The glucocorticoid receptor gene and its association to metabolic syndrome." Obes. Res. (2002) 10(10):1078-1086.

Saison-Behmoaras et al., "Short modified antisense oligonucleotides directed against Ha-ras point mutation induce selective cleavage of the mRNA and inhibit T24 cells proliferation." EMBO J. (1991) 10(5):1111-1118.

Sanghvi et al., "Heterocyclic Base Modifications in Nucleic Acids and Their Applications in Antisense Oligonucleotides" Antisense Research and Applications (1993) pp. 273-288.

Scaringe "RNA oligonucleotide synthesis via 5'-silyl-2'-orthoester chemistry." Methods (2001) 23(3):206-217.

Schievella et al., "Protein tyrosine phosphatase 1B undergoes mitosis-specific phosphorylation on serine." Cell Growth Differ. (1993) 4(4):239-246.

Seely et al., "Protein tyrosine phosphatase 1B interacts with the activated insulin receptor." Diabetes (1996) 45(10):1379-1385.

Sell et al., "Insulin-inducible changes in the relative ratio of PTP1B splice variants." Mol. Genet. Metab. (1999) 66(3):189-192.

Shea et al., "Synthesis, hybridization properties and antiviral activity of lipid-oligodeoxynucleotide conjugates." Nucleic Acids Res. (1990) 18(13):3777-3783.

Shifrin and Neel, "Growth factor-inducible alternative splicing of nontransmembrane phosphotyrosine phosphatase PTP-1B pre-mRNA." J. Biol. Chem. (1993) 268(34):25376-25384.

Siani et al., "Gly40Ser polymorphism of the glucagon receptor gene is associated with central adiposity in men." Obes. Res. (2001) 9(11):722-726.

Sindelka et al., "Association of Obesity, Diabetes, Serum Lipids and Blood Pressure Regulates Insulin Action" Physiol. Res. (2002) 51:85-91.

Singh et al., "Synthesis of 2'-Amino-LNA: A Novel Conformationally Restricted High-Affinity Oligonucleotide Analogue with a Handle" J. Org. Chem. (1998) 63(26):10035-10039.

Singh et al., "LNA (locked nucleic acids): synthesis and high-affinity nucleic acid recognition" Chem. Commun. (1998) 4:455-456.

Smith et al., "Obesity resistance and multiple mechanisms of triglyceride synthesis in mice lacking Dgat." Nat. Genet. (2000) 25(1):87-90.

Stein, "The experimental use of antisense oligonucleotides: a guide for the perplexed" J. Clinical Invest. (2001) 108(5):641-644.

Svinarchuk et al., "Inhibition of HIV proliferation in MT-4 cells by antisense oligonucleotide conjugated to lipophilic groups." Biochimie (1993) 75(1-2):49-54.

Tonks et al., "Characterization of the major protein-tyrosine-phosphatases of human placenta." J. Biol. Chem. (1988) 263(14):6731-6737.

Tonks et al., "Purification of the major protein-tyrosine-phosphatases of human placenta." J. Biol. Chem. (1988) 263(14):6722-6730.

Wahlestedt et al., "Potent and nontoxic antisense oligonucleotides containing locked nucleic acids." PNAS (2000) 97(10):5633-5638.

Wancewicz et al., "ISIS-370717 is a 12 Nucleotide Antisense Oligonucleotide that Promotes Depletion of SGLT2 RNA in Rodens" Poster Presentation, Oligonucleotide Therapeutics Society (OTS) Inaugural Meeting, Rockefeller University, Sep. 15-18, 2005.

Waterman et al., "Distinct ontogenic patterns of overt and latent DGAT activities of rat liver microsomes." J. Lipid Res. (2002) 43(9):1555-1562.
Wells et al., Cloning of a human kidney cDNA with similarity to the soidum-glucose cotransporter Am. J. Physiol. (1992) 263:F459-465.
Wright, "Renal Na(+)-glucose cotransporters." Am. J. Physiol. Renal Physiol. (2001) 280(1):F10-F18.
You et al., "Molecular characteristics of Na(+)-coupled glucose transporters in adult and embryonic rat kidney." J. Biol. Chem. (1995) 270(49):29365-29371.
Zamecnik et al., "Inhibition of Rous sarcoma virus replication and cell transformation by a specific oligodeoxynucleotide." Proc. Natl. Acad. Sci. U.S.A. (1978) 75(1):280-284.
Extended European Search Report for Application No. EP 07811874.2 dated Mar. 30, 2009.
International Search Report for Application No. PCT/US2007/068404 dated Mar. 13, 2008.
"Top 20 Pharma: Boehringer Ingelheim" Contract Pharma (2008) 96.
European Search Report for EP07811875.9 dated Jun. 2, 2009.
Altschul et al., "Basic Local Alignment Search Tool" J. Mol. Biol. (1990) 215:403-410.
Babu et al., "Conformationally locked aryl C-nucleosides: synthesis of phosphoramidite monomers and incorporation into single-stranded DNA and LNA (locked nucleic acid)" J. Chem. Soc. (2002) Perkin Trans. 1, pp. 2509-2519.
Barany et al., "A New Amino Protecting Group Removable by Reduction. Chemistry of the Dithiasuccinoyl (Dts) Function" J. Am. Chem. Soc. (1977) 99:7363-7365.
Barany et al., "Kinetics and Mechanisms of the Thiolytic Removal of the Dithiasuccinoyl (Dts) Amino Protecting Group" J. Am. Chem. Soc. (1980) 102:3084-3095.
Bass, "Double-stranded RNA as a template for gene silencing" Cell (2000) 101:235-238.
Beaucage et al., "The Functionalization of Oligonucleotides via Phosphoramidite Derivatives" Tetrahedron (1993) 49:1925-1963.
Beaucage et al., "The Synthesis of Specific Ribonucleotides and Unrelated Phosphorylated Biomolecules by the Phosphoramidite Method" Tetrahedron (1993) 49:10441-10488.
Beaucage et al., "Advances in the Synthesis of Oligonucleotides by the Phosphoramidite Approach" Tetrahedron (1992) 48:2223-2311.
Beigelman et al., "Synthesis of 5'-C-Methyl-D-Allo- & L-Talo-Ribonucleoside 3'-O-Phosphoramidies and Their Incorporation into Hammerhead Ribozymes" Nucleoside Nucleotides (1995) 14:901-905.
Brazma et al., "Gene expression data analysis" FEBS Letters (2000) 480:17-24.
Carey et al., Advanced Organic Chemistry, Part B: Reactions and Synthesis 4th Ed. (2001) Kluwer Academic/Plenum Publisher, New York.
Carulli et al., "High Throughput Analysis of Differential Gene Expression" J. Cell. Biochem. Suppl. (1998) 30:286-296.
Celis et al., "Gene expression profiling: monitoring transcription and translation products using DNA microarrays and proteomics" FEBS Lett (2000) 480:2-16.
Chiang et al., "Antisense Oligonucleotides Inhibit Intercellular Adhesion Molecule 1 Expression by Two Distinct Mechanisms" J. Biol. Chem. (1991) 266:18162-18171.
Eckstein, Oligonucleotides and Analogues, a Practical Approach (1991) Oxford Univ. Press, NY.
Elbashir, "Duplexes of 21-nucleotide RNAs mediate RNA interference in cultured mammalian cells" Nature (2001) 411:494-498.
Elbashir, "RNA interference is mediated by 21- and 22-nucleotide RNAs" Genes & Devel. (2001) 15:188-200.
Englisch et al., "Chemically Modified Oligonucleotides as Probes and Inhibitors" Agnew Chem. Int. Ed. Engl. (1991) 30:613-629.
Fire et al., "Potent and Specific Genetic Interference by Double-Stranded RNA in Caenorhabditis elegans" Nature (1998) 391:806-811.
Fuchs et al., "Identification of Differentially Expressed Genes by Mutually Subtracted RNA Fingerprinting" Anal. Biochem. (2000) 286:91-98.
Gait, "Oligoribonucleotides" Antisense Research and Applications (1993), CRC Press, Boca Raton, pp. 289-301.

Gait et al., "Application of chemically synthesized RNA" RNA: Protein Interactions (1998) 1-36.
Gallo et al., "2'-C-Methyluridine Phosphoramidite: A New Building Block for the Preparation of RNA Analogues Carrying the 2'-Dydroxyl Group" Tetrahedron (2001) 57: 5707-5713.
Going et al., "Molecular Pathology and Future Developments" Eur. J. Cancer (1999) 35:1895-1904.
Hari et al., "Synthesis and properties of oligonucleotides containing novel 2',4'-BNA analogues (2',4'-BNAcoc)" Nucleic Acids Research Supplement No. 2 (2002) 147-148.
Hornbeck et al., "Enzyme-Linked Immunosorbet Assays (ELISA)" Curr. Protocols Mol. Biol. (1991) John Wiley & Sons 11.2.1-11.2.22.
International Search Report for PCT/US2007/061183 dated Jan. 27, 2007.
International Search Report for PCT/US2007/068690 dated Nov. 30, 2007.
Jungblut et al., "Proteomics in human disease: Cancer, heart and infections diseases" Electrophoresis (1999) 20:2100-2110.
Jurecic et al., "Long-distance DD-PCR and cDNA microarrays" Curr. Opin. Microbiol. (2000) 3:316-321.
Koshkin et al., "LNA (locked nucleic acids): Synthesis of the adenine, cytosine, guanine, 5-methylcytosine, thymine and uracil bicyclonucleoside monomers, oligomerisation, and unprecedented nucleic acid recognition" Tetrahedron (1998) 54:3607-3630.
Kroschwitz, "Polynucleotides" Concise Encyclopedia of Polymer Science and Engineering (1990) John Wiley & Sons, NY pp. 858-859.
Kumar et al., "The first analogues of LNA (locked nucleic acids): phosphorothioate-LNA and 2'-thio-LNA" Bioorg Med Chem Lett. (1998) 8:2219-2222.
Lane et al., "NMR assignments and solution conformation of the DNA:RNA hybrid duplex d(GTGAACTT)r(AAGUUCAC)" Eur. J. Biochem. (1993) 215:297-306.
Larson et al., "Rapid DNA Fingerprinting of Pathogens by Flow Cytometry" Cytometry (2000) 41:203-208.
Larsson et al., "High-throughput protein expression of cDNA products as a tool in functional genomics" J. Biotech. (2000) 80:143-157.
Madden et al., "Serial analysis of gene expression: from gene discovery to target identification" DDT (2000) 5:415-425.
Mikhailov et al., "Substrate Properties of C'-Methylnucleoside and C'-Methyl-2'-Deoxynucleoside 5'-Triphosphates in RNA and DNA Synthesis Reactions Catalysed by RNA and DNA Polymerase" Nucleosides Nucleotides (1991) 10:339-343.
Montgomery et al., "RNA as a target of double-stranded RNA-mediated genetic interference in Caenorhabditis elegans" Proc Natl. Acad. Sci. (1998) 95:15502-7.
Nishikura, "A Short Primer on RNAi: RNA-Directed RNA Polymerase Acts as a Key Catalyst" Cell (2001) 107:415-418.
Prashar et al., "READS: a Method for Display of 3'-End Fragment of Restriction Enzyme-Digested cDNAs for Analysis of Differential Gene Expression" Methods Enzymol. (1999) 303:258-272.
Saha et al., "5'-Me-DNA—A New Oligonucleotide Analog: Synthesis and Biochemical Properties" J. Org. Chem. (1995) 60:788-789.
Sanghvi, Chapter 15, Antisense Research and Applications, pp. 289-302, Crooke and Lebleu ed., CRC Press (1993).
Scaringe, "RNA Oligonucleotide Synthesis via 5'-Silyl-2'-Orthoester Chemistry" Methods (2001) 23:206-217.
Singh et al., "Synthesis of 2'-amino-LNA: A novel conformationally restricted high-affinity oligonucleotide analogue with a handle" J. Org. Chem. (1998) 63: 10035-10039.
Singh et al., "LNA (locked nucleic acids): synthesis and high-affinity nucleic acid recognition" Chem. Commun. (1998) 455-456.
Sonveaux, "Protecting Groups in Oligonucleotide Synthesis" Protocols for Oligonucleotide Conjugates (1994) 26:1-71.
Sutcliffe et al., "TOGA: An automated parsing technology for analyzing expression of nearly all genes" PNAS (2000) 97:1976-1981.
Swayze et al., "Antisense oligonucleotides containing locked nucleic acid improve potency but cause significant hepatotoxicity in animals" Nucleic Acids Res. (2007) 35:687-700.
Tabara et al., "RNAi in C. elegans: Soaking in the Genome Sequence" Science (1998) 282:430-431.

Tijsterman et al., "RNA hellcase MUT-14-dependent gene silencing triggered in *C. elegans* by short antisense RNAs" Science (2002) 295:694-7.

Timmons et al., "Specific Interference by Ingested dsRNA" Nature (1998) 395:854.

Timmons et al., "Ingestion of bacterially expressed dsRNAs can produce specific and potent genetic interference in *Caenorhabditis elegans*" Gene (2001) 263:103-112.

To, "Identification of Differential Gene Expression by High Throughput Analysis" Comb. Chem. High Throughput Screen (2000) 3:235-241.

Tuschl et al., "Targeted mRNA degradation by double-stranded RNA in vitro" Genes Dev. (1999) 13:3191-7.

Wahlestedt et al., "Potent and nontoxic antisense oligonucleotide containing locked nucleic acids" Proc. Natl. Acad. Sci. USA (2000) 97: 5633-5638.

Wang et al., "5'-C-Branched Thymidines: Synthesis, Sterochemistry, and Incorporation into Oligodeoxynucleotides" Tetrahedron Letters (1996) 37:2739-2742.

Wang et al., "Biophysical and Biochemical Properties of Oligodeoxynucleotides Containing 4'-C- and 5'-C-Substituted Thymidines" Bioorg. Med. Chem. Lett. (1999) 9:885-890.

Wuts et al., Greene's Protective Groups in Organic Synthesis 4th Ed. (2007) John Wiley & Sons, NY.

Youssefyeh et al., "4'-Substituted Nucleosides. 4. Synthesis of some 4'-Hydroxymethyl Nucleosides" J. Org. Chem. (1979) 44:1301-1309.

Zhang et al., "PowerBLAST: A New Network BLAST Application for Interactive or Automated Sequence Analysis and Annotation" Genome Res. (1997) 7:649-656.

* cited by examiner

COMPOUNDS AND METHODS FOR MODULATING EXPRESSION OF SGLT2

CROSS-REFERENCE TO RELATED APPLICATIONS

This application is a continuation of U.S. application Ser. No. 12/299,611, filed Mar. 11, 2009, which is a US National Phase filing under 35 U.S.C. 371 claiming priority to International Application Serial No. PCT/US2007/068406 filed May 7, 2007. International Application Serial No. PCT/US2007/068406 claims benefit of priority under 35 USC 119(e) to U.S. Provisional Ser. No. 60/746,631 filed May 5, 2006, U.S. Provisional Ser. No. 60/864,554 filed Nov. 6, 2006, U.S. Provisional Ser. No. 60/805,660 filed Jun. 23, 2006, and U.S. Provisional Application No. 60/747,059 filed May 11, 2006 and claims priority to Patent Cooperation Treaty Application No. PCT/US2007/061183, filed Jan. 27, 2007; each of which is being incorporated herein by reference in its entirety.

SEQUENCE LISTING

The present application is being filed along with a Sequence Listing in electronic format. The Sequence Listing is provided as a file entitled CORE0061USA9C1SEQ.TXT, created on Sep. 9, 2010 which is 684 Kb in size. The information in the electronic format of the sequence listing is incorporated herein by reference in its entirety.

BACKGROUND

Targeting disease-causing gene sequences was first suggested nearly 40 years ago (Belikova et al., Tet. Lett., 1967, 37, 3557-3562), and antisense activity was demonstrated in cell culture a decade later (Zamecnik et al., Proc. Natl. Acad. Sci. U.S.A., 1978, 75, 280-284). One advantage of antisense technology in the treatment of a disease or condition that stems from a disease-causing gene is that it is a direct genetic approach that has the ability to modulate expression of specific disease-causing genes.

Generally, the principle behind antisense technology is that an antisense compound hybridizes to a target nucleic acid and effects modulation of gene expression activity or function, such as transcription, translation or splicing. The modulation of gene expression can be achieved by, for example, target degradation or occupancy-based inhibition. An example of modulation of RNA target function by degradation is RNase H-based degradation of the target RNA upon hybridization with a DNA-like antisense compound. Another example of modulation of gene expression by target degradation is RNA interference (RNAi). RNAi is a form of antisense-mediated gene silencing involving the introduction of dsRNA leading to the sequence-specific reduction of targeted endogenous mRNA levels. Sequence-specificity makes antisense compounds extremely attractive as tools for target validation and gene functionalization, as well as research tools for identifying and characterizing nucleases and as therapeutics to selectively modulate the expression of genes involved in the pathogenesis of any one of a variety of diseases.

Antisense technology is an effective means for reducing the expression of one or more specific gene products and can therefore prove to be uniquely useful in a number of therapeutic, diagnostic, and research applications. Chemically modified nucleosides are routinely used for incorporation into antisense compounds to enhance one or more properties, such as nuclease resistance, pharmacokinetics or affinity for a target RNA.

Despite the expansion of knowledge since the discovery of antisense technology, there remains an unmet need for antisense compounds with greater efficacy, reduced toxicity and lower cost. Until the present disclosure, high-affinity modifications have not been employed in the design of short antisense compounds for reducing target RNA in vivo. This is because of concerns regarding the degree of target specificity that a sequence 15 nucleotides or shorter would have when employed to reduce target in a living system. Previous studies have described that greater specificity, and therefore greater potential for potency, is achieved by antisense compounds between 16 and 20 nucleobases in length.

The present disclosure describes incorporation of chemically-modified high-affinity nucleotides into antisense compounds allows for short antisense compounds about 8-16 nucleobases in length useful in the reduction of target RNAs in animals with increased potency and improved therapeutic index. Thus, provided herein are short antisense compounds comprising high-affinity nucleotide modifications useful for reducing a target RNA in vivo. Such short antisense compounds are effective at lower doses than previously described antisense compounds, allowing for a reduction in toxicity and cost of treatment.

SUMMARY

Disclosed herein are short antisense compounds and methods of using said compounds to reduce target RNA expression in cells or tissues. In certain embodiments, provided herein is a method of reducing expression of a target in an animal, comprising administering to the animal a short antisense compound targeted to a nucleic acid of such target. In certain embodiments, shorts antisense compounds are oligonucleotide compounds. In certain embodiments short antisense oligonucleotides are about 8 to 16, preferably 9 to 15, more preferably 9 to 14, more preferably 10 to 14 nucleotides in length and comprises a gap region flanked on each side by a wing, wherein each wing independently consists of 1 to 3 nucleotides. Preferred motifs include but are not limited to wing-deoxy gap-wing motifs selected from 3-10-3, 2-10-3, 2-10-2, 1-10-1, 2-8-2, 1-8-1, 3-6-3 or 1-6-1. In a preferred embodiment, the short antisense oligonucleotide comprise at least one high-affinity modification. In a further embodiment, the high-affinity modification includes chemically-modified high-affinity nucleotides. In a preferred embodiment, each wing independently consists of 1 to 3 high-affinity modified nucleotides. In one embodiment the high affinity modified nucleotides are sugar-modified nucleotides.

In certain embodiments short antisense compounds exhibit greater uptake in the gut as compared to antisense compounds of greater length. Thus, also provided herein are methods of reducing a target in an animal, comprising orally administering the short antisense compounds of the present invention.

In certain embodiments, short antisense compounds are targeted to a nucleic acid encoding a protein selected from ApoB, SGLT2, PCSK9, SOD1, CRP, GCCR, GCGR, DGAT2, PTP1B and PTEN.

Further provided are methods of treating a metabolic disorder in an animal, comprising administering to an animal in need of such therapy a short antisense compound targeted to a nucleic acid involved in regulating glucose metabolism or clearance, lipid metabolism, cholesterol metabolism, or insulin signaling.

Also provided are methods of increasing insulin sensitivity, decreasing blood glucose or decreasing $HbA_{1c}$ in an animal, comprising administering to said animal a short antisense compound targeted to a nucleic acid encoding a target involved in regulating glucose metabolism or clearance, lipid metabolism, cholesterol metabolism, or insulin signaling.

Further provided are methods of decreasing total serum cholesterol, serum LDL, serum VLDL, serum HDL, serum triglycerides, serum apolipoprotein(a) or free fatty acids in an animal, comprising administering to said animal a short antisense compound targeted to a nucleic acid encoding a target that is involved in regulating glucose metabolism or clearance, lipid metabolism, cholesterol metabolism, or insulin signaling, wherein said short antisense compound is 8 to 16 nucleotides in length and comprises a gap region flanked on each side by a wing, wherein each wing independently consists of 1 to 3 high-affinity modified nucleotides.

Certain targets involved in regulating glucose metabolism or clearance, lipid metabolism, cholesterol metabolism, or insulin signaling include, but are not limited to, GCGR and ApoB-100. Thus, provided are short antisense compounds targeting nucleic acids encoding GCGR and ApoB-100 and methods of reducing expression of said targets and/or target nucleic acids in animal. In addition, provided is the use of short antisense compounds targeting nucleic acids encoding GCGR, and ApoB-100 for the treatment of a metabolic or cardiovascular disease or condition.

In certain embodiments, short antisense compounds further comprise a conjugate group. Conjugate groups include, but are not limited to, $C_{16}$ and cholesterol.

In certain embodiments short antisense compounds comprise at least one modified nucleobase, internucleoside linkage or sugar moiety. In certain embodiments, such modified internucleoside linkage is a phosphorothioate internucleoside linkage. In certain embodiments, each internucleoside linkage is a phosphorothioate internucleoside linkage.

In certain embodiments, short antisense compounds comprise at least one high affinity modification. In certain such embodiments, the high-affinity modification is a chemically-modified high-affinity nucleotide. In certain embodiments, chemically-modified high affinity nucleotides are sugar-modified nucleotides. In certain embodiments, at least one of the sugar-modified nucleotides comprises a bridge between the 4' and the 2' position of the sugar. Each of the sugar-modified nucleotides is, independently, in the β-D or α-L sugar conformation. In certain embodiments, each of said high-affinity modified nucleotides confers a $T_m$ of at least 1 to 4 degrees per nucleotide. In certain embodiments, each of said sugar-modified nucleotides comprises a 2'-substituent group that is other than H or OH. Such sugar-modified nucleotides include those having a 4' to 2' bridged bicyclic sugar moiety. In certain embodiments, each of the 2'-substituent groups is, independently, alkoxy, substituted alkoxy, or halogen. In certain embodiments, each of the 2'-substituent groups is $OCH_2CH_2OCH_3$ (2'-MOE).

In certain embodiments, short antisense compounds have one or more sugar-modified nucleotides comprising a bridge between the 4' and 2' position of the sugar, wherein each of said bridges independently comprises from 2 to 4 linked groups independently selected from —[C(R$_1$)(R$_2$)]$_n$—, —C(R$_1$)=C(R$_2$)—, —C(R$_1$—)=N—, —C(=NR$_1$)—, —C(=O)—, —C(=S)—, —O—, —Si(R$_1$)$_2$—, —S(=O)$_n$— and —N(R$_1$)—;
  wherein
  x is 0, 1, or 2;
  n is 1, 2, 3, or 4;

each R$_1$ and R$_2$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl or a protecting group.

In one aspect, each of said bridges is, independently, —[C(R$_1$)(R$_2$)]$_n$—, —[C(R$_1$)(R$_2$)]$_n$—O—, —C(R$_1$R$_2$)—N(R$_1$)—O— or —C(R$_1$R$_2$)—O—N(R$_1$)—. In another aspect, each of said bridges is, independently, 4'-(CH$_2$)$_3$-2',4'-(CH$_2$)$_2$-2',4'-CH$_2$—O-2',4'-(CH$_2$)$_2$—O-2',4'-CH$_2$—O—N(R$_1$)-2' and 4'-CH$_2$—N(R$_1$)—O-2'- wherein each R$_1$ is, independently, H, a protecting group or C$_1$-C$_{12}$ alkyl.

In certain embodiments, provided herein are short antisense compounds useful in the reduction of targets and/or target RNAs associated with disease states in animals. In certain embodiments, provided are methods of using the short antisense compounds for reducing expression of a target RNA in an animal. In certain embodiments, provided herein is the use of a short antisense compound in the preparation of a medicament for the treatment of a metabolic disorder in an animal. In certain embodiments, provided herein is the use of a short antisense compound in the preparation of a medicament for increasing insulin sensitivity, decreasing blood glucose or decreasing $HbA_{1c}$ in an animal. Also provided is the use of a short antisense compound in the preparation of a medicament for decreasing total serum cholesterol, serum LDL, serum VLDL, serum HDL, serum triglycerides, serum apolipoprotein(a) or free fatty acids in an animal.

In certain embodiments, short antisense compounds provided herein exhibit equal or increased potency with regard to target RNA knockdown as compared to longer parent antisense oligonucleotide at least 20 nucleotides in length. In certain embodiments, short antisense compounds exhibit a faster onset of action (target RNA reduction) as compared to the parent antisense oligonucleotide. In certain embodiments, increased potency is in the kidney. In certain embodiments, target RNA is predominately expressed in the kidney. In certain embodiments, increased potency is in the liver. In certain embodiments, target RNA is predominately expressed in the liver.

DETAILED DESCRIPTION

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference in their entirety for any purpose. U.S. patent application Ser. Nos 10/712,795 and 10/200,710 are hereby expressly incorporated by reference in their entirety for any purpose.

A. DEFINITIONS

Unless specific definitions are provided, the nomenclature utilized in connection with, and the procedures and techniques of, analytical chemistry, synthetic organic chemistry, and medicinal and pharmaceutical chemistry described herein are those well known and commonly used in the art. Standard techniques may be used for chemical synthesis, chemical analysis, pharmaceutical preparation, formulation and delivery, and treatment of subjects. Certain such techniques and procedures may be found for example in "Carbohydrate Modifications in Antisense Research" Edited by Sangvi and Cook, American Chemical Society, Washington D.C., 1994; and "Remington's Pharmaceutical Sciences," Mack Publishing Co., Easton, Pa., 18th edition, 1990; and which is hereby incorporated by reference for any purpose. Where permitted, all patents, applications, published applications and other publications and sequences from GenBank and other data bases referred to throughout in the disclosure herein are incorporated by reference in their entirety.

Unless otherwise indicated, the following terms have the following meanings:

As used herein, the term "nucleoside" means a glycosylamine comprising a nucleobase and a sugar. Nucleosides includes, but are not limited to, naturally occurring nucleosides, abasic nucleosides, modified nucleosides, and nucleosides having mimetic bases and/or sugar groups.

As used herein, the term "nucleotide" refers to a glycosomine comprising a nucleobase and a sugar having a phosphate group covalently linked to the sugar. Nucleotides may be modified with any of a variety of substituents.

As used herein, the term "nucleobase" refers to the base portion of a nucleoside or nucleotide. A nucleobase may comprise any atom or group of atoms capable of hydrogen bonding to a base of another nucleic acid.

As used herein, the term "heterocyclic base moiety" refers to a nucleobase comprising a heterocycle.

As used herein, the term "deoxyribonucleotide" means a nucleotide having a hydrogen at the 2' position of the sugar portion of the nucleotide. Deoxyribonucleotides may be modified with any of a variety of substituents.

As used herein, the term "ribonucleotide" means a nucleotide having a hydroxy at the 2' position of the sugar portion of the nucleotide. Ribonucleotides may be modified with any of a variety of substituents.

As used herein, the term "oligomeric compound" refers to a polymeric structure comprising two or more sub-structures and capable of hybridizing to a region of a nucleic acid molecule. In certain embodiments, oligomeric compounds are oligonucleosides. In certain embodiments, oligomeric compounds are oligonucleotides. In certain embodiments, oligomeric compounds are antisense compounds. In certain embodiments, oligomeric compounds are antisense oligonucleotides. In certain embodiments, oligomeric compounds are short antisense compounds. In certain embodiments, oligomeric compounds are short antisense oligonucleotides. In certain embodiments, oligomeric compounds are chimeric oligonucleotides.

As used herein, the term "monomer" refers to a single unit of an oligomer. Monomers include, but are not limited to, nucleosides and nucleotides, whether naturally occurring or modified.

As used herein "oligonucleoside" refers to an oligonucleotide in which the internucleoside linkages do not contain a phosphorus atom.

As used herein, the term "oligonucleotide" refers to an oligomeric compound comprising a plurality of linked nucleotides. In certain embodiment, one or more nucleotides of an oligonucleotide is modified. In certain embodiments, an oligonucleotide comprises ribonucleic acid (RNA) or deoxyribonucleic acid (DNA). In certain embodiments, oligonucleotides are composed of naturally- and/or non-naturally-occurring nucleobases, sugars and covalent internucleotide linkages, and may further include non-nucleic acid conjugates.

As used herein "internucleotide linkage" refers to a covalent linkage between adjacent nucleotides.

As used herein, the term "monomeric linkage" refers to a covalent linkage between two monmers. Monomeric linkages include, but are not limited to internucleotide linkages and internucleoside linkages.

As used herein "naturally occurring internucleotide linkage" refers to a 3' to 5' phosphodiester linkage.

As used herein, the term "antisense compound" refers to an oligomeric compound that is at least partially complementary to a target nucleic acid molecule to which it hybridizes. In certain embodiments, an antisense compound modulates (increases or decreases) expression of a target nucleic acid. Antisense compounds include, but are not limited to, compounds that are oligonucleotides, oligonucleosides, oligonucleotide analogs, oligonucleotide mimetics, and chimeric combinations of these. Consequently, while all antisense compounds are oligomeric compounds, not all oligomeric compounds are antisense compounds.

As used herein, the term "antisense oligonucleotide" refers to an antisense compound that is an oligonucleotide.

As used herein, the term "parent antisense oligonucleotide" refers to an oligonucleotide 20 nucleotides in length having a deoxy gap region having ten 2'-deoxyribonucleotides, flanked by a first and a second wing region each having five 2'-O-(2-methoxyethyl) ribonucleotides (a 5-10-5 MOE gapmer) and comprising the sequence of the corresponding short antisense compound to which it is a parent.

As used herein, the term "short antisense compound" refers to an antisense compound about 8, 9, 10, 11, 12, 13, 14, 15 or 16 monomers in length. In certain embodiments, a short antisense compound has at least one high-affinity modification.

As used herein, the term "short antisense oligonucleotide" or refers to an antisense oligonucleotide about 8, 9, 10, 11, 12, 13, 14, 15 or 16 nucleotides in length. In certain embodiments, a short antisense oligonucleotide has at least one high-affinity modification.

As used herein, the term "short gapmer" refers to a short antisense oligonucleotide having a first and a second wing region each independently 1 to 3 nucleotides in length and a gap region 2 to 14 nucleobase in length.

As used herein, the term "motif" refers to the pattern of unmodified and modified nucleotides in a short antisense compound.

As used herein, the term "chimeric antisense oligomer" refers to an antisense oligomeric compound, having at least one sugar, nucleobase or internucleoside linkage that is differentially modified as compared to at least on other sugar, nucleobase or internucleoside linkage within the same antisense oligomeric compound. The remainder of the sugars, nucleobases and internucleoside linkages can be independently modified or unmodified, the same or different.

As used herein, the term "chimeric antisense oligonucleotide" refers to an antisense oligonucleotide, having at least one sugar, nucleobase or internucleoside linkage that is differentially modified as compared to at least on other sugar, nucleobase or internucleoside linkage within the same antisense oligonucleotide. The remainder of the sugars, nucleobases and internucleoside linkages can be independently modified or unmodified, the same or different.

As used herein, the term "mixed-backbone antisense oligonucleotide" refers to an antisense oligonucleotide wherein at least one internucleoside linkage of the antisense oligonucleotide is different from at least one other internucleotide linkage of the antisense oligonucleotide.

As used herein, the term "target" refers to a protein, the modulation of which is desired.

As used herein, the term "target gene" refers to a gene encoding a target.

As used herein, the terms "target nucleic acid" and "nucleic acid molecule encoding a target" refer to any nucleic acid molecule the expression or activity of which is capable of being modulated by an antisense compound. Target nucleic acids include, but are not limited to, RNA (including, but not limited to pre-mRNA and mRNA or portions thereof) transcribed from DNA encoding a target, and also cDNA derived from such RNA, and miRNA. For example, the target nucleic acid can be a cellular gene (or mRNA transcribed from the gene) whose expression is associated with a particular disorder or disease state, or a nucleic acid molecule from an infectious agent.

As used herein, the term "targeting" or "targeted to" refers to the association of an antisense compound to a particular target nucleic acid molecule or a particular region of nucleotides within a target nucleic acid molecule.

As used herein, the term "5' target site" refers to the nucleotide of a target nucleic acid which is complementary to the 5'-most nucleotide of a particular antisense compound.

As used herein, the term "3' target site" refers to the nucleotide of a target nucleic acid which is complementary to the 3'-most nucleotide of a particular antisense compound.

As used herein, the term "target region," refers to a portion of a target nucleic acid to which one or more antisense compounds is complementary.

As used herein, the term "target segment" refers to a smaller or sub-portions of a region within a target nucleic acid.

As used herein, the term "nucleobase complementarity" refers to a nucleobase that is capable of base pairing with another nucleobase. For example, in DNA, adenine (A) is complementary to thymine (T). For example, in RNA, adenine (A) is complementary to uracil (U). In certain embodiments, complementary nucleobase refers to a nucleobase of an antisense compound that is capable of base pairing with a nucleobase of its target nucleic acid. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be complementary at that nucleobase pair.

As used herein, the term "non-complementary nucleobase" refers to a pair of nucleobases that do not form hydrogen bonds with one another or otherwise support hybridization.

As used herein, the term "complementary" refers to the capacity of an oligomeric compound to hybridize to another oligomeric compound or nucleic acid through nucleobase complementarity. In certain embodiments, an antisense compound and its target are complementary to each other when a sufficient number of corresponding positions in each molecule are occupied by nucleobases that can bond with each other to allow stable association between the antisense compound and the target. One skilled in the art recognizes that the inclusion of mismatches is possible without eliminating the ability of the oligomeric compounds to remain in association. Therefore, described herein are antisense compounds that may comprise up to about 20% nucleotides that are mismatched (i.e., are not nucleobase complementary to the corresponding nucleotides of the target). Preferably the antisense compounds contain no more than about 15%, more preferably not more than about 10%, most preferably not more than 5% or no mismatches. The remaining nucleotides are nucleobase complementary or otherwise do not disrupt hybridization (e.g., universal bases). One of ordinary skill in the art would recognize the compounds provided herein are at least 80%, at least 85%, at least 90%, at least 95%, at least 96%, at least 97%, at least 98%, at least 99% or 100% complementary to a target nucleic acid.

As used herein, the term "mismatch" refers to a non-complementary nucleobase within a complementary oligomeric compound.

As used herein, "hybridization" means the pairing of complementary oligomeric compounds (e.g., an antisense compound and its target nucleic acid). While not limited to a particular mechanism, the most common mechanism of pairing involves hydrogen bonding, which may be Watson-Crick, Hoogsteen or reversed Hoogsteen hydrogen bonding, between complementary nucleoside or nucleotide bases (nucleobases). For example, the natural base adenine is nucleobase complementary to the natural nucleobases thymidine and uracil which pair through the formation of hydrogen bonds. The natural base guanine is nucleobase complementary to the natural bases cytosine and 5-methyl cytosine. Hybridization can occur under varying circumstances.

As used herein, the term "specifically hybridizes" refers to the ability of an oligomeric compound to hybridize to one nucleic acid site with greater affinity than it hybridizes to another nucleic acid site. In certain embodiments, an antisense oligonucleotide specifically hybridizes to more than one target site.

As used herein, "designing" or "designed to" refer to the process of designing an oligomeric compound that specifically hybridizes with a selected nucleic acid molecule.

As used herein, the term "modulation" refers to a perturbation of function or activity when compared to the level of the function or activity prior to modulation. For example, modulation includes the change, either an increase (stimulation or induction) or a decrease (inhibition or reduction) in gene expression. As further example, modulation of expression can include perturbing splice site selection of pre-mRNA processing.

As used herein, the term "expression" refers to all the functions and steps by which a gene's coded information is converted into structures present and operating in a cell. Such structures include, but are not limited to the products of transcription and translation.

As used herein, "variant" refers to an alternative RNA transcript that can be produced from the same genomic region of DNA. Variants include, but are not limited to "pre-mRNA variants" which are transcripts produced from the same genomic DNA that differ from other transcripts produced from the same genomic DNA in either their start or stop position and contain both intronic and exonic sequence. Variants also include, but are not limited to, those with alternate splice junctions, or alternate initiation and termination codons.

As used herein, "high-affinity modified monomer" refers to a monomer having at least one modified nucleobase, internucleoside linkage or sugar moiety, when compared to naturally occurring monomers, such that the modification increases the affinity of an antisense compound comprising the high-affinity modified monomer to its target nucleic acid. High-affinity modifications include, but are not limited to, monomers (e.g., nucleosides and nucleotides) comprising 2'-modified sugars.

As used herein, the term "2'-modified" or "2'-substituted" means a sugar comprising substituent at the 2' position other than H or OH. 2'-modified monomers, include, but are not limited to, BNA's and monomers (e.g., nucleosides and nucleotides) with 2'-substituents, such as allyl, amino, azido, thio, O-allyl, O—$C_1$-$C_{10}$ alkyl, —$OCF_3$, O—$(CH_2)_2$—O—$CH_3$, 2'-$O(CH_2)_2SCH_3$, O—$(CH_2)_2$—O—$N(R_m)(R_n)$, or O—$CH_2$—C(=O)—$N(R_m)(R_n)$, where each $R_m$ and $R_n$ is, independently, H or substituted or unsubstituted $C_1$-$C_{10}$ alkyl. In certain embodiments, short antisense compounds comprise a 2'modified monomer that does not have the formula 2'-$O(CH_2)_nH$, wherein n is one to six. In certain embodiments, short antisense compounds comprise a 2'modified monomer that does not have the formula 2'-$OCH_3$. In certain embodiments, short antisense compounds comprise a 2'modified monomer that does not have the formula or, in the alternative, 2'-$O(CH_2)_2OCH_3$.

As used herein, the term "bicyclic nucleic acid" or "BNA" or "bicyclic nucleoside" or "bicyclic nucleotide" refers to a nucleoside or nucleotide wherein the furanose portion of the nucleoside includes a bridge connecting two carbon atoms on the furanose ring, thereby forming a bicyclic ring system.

As used herein, unless otherwise indicated, the term "methyleneoxy BNA" alone refers to β-D-methyleneoxy BNA.

As used herein, the term "MOE" refers to a 2'-methoxyethyl substituent.

As used herein, the term "gapmer" refers to a chimeric oligomeric compound comprising a central region (a "gap") and a region on either side of the central region (the "wings"), wherein the gap comprises at least one modification that is different from that of each wing. Such modifications include nucleobase, monomeric linkage, and sugar modifications as well as the absence of modification (unmodified). Thus, in certain embodiments, the nucleotide linkages in each of the wings are different than the nucleotide linkages in the gap. In certain embodiments, each wing comprises nucleotides with high affinity modifications and the gap comprises nucleotides that do not comprise that modification. In certain embodiments the nucleotides in the gap and the nucleotides in the wings all comprise high affinity modifications, but the high affinity modifications in the gap are different than the high affinity modifications in the wings. In certain embodiments, the modifications in the wings are the same as one another. In certain embodiments, the modifications in the wings are different from each other. In certain embodiments, nucleotides in the gap are unmodified and nucleotides in the wings are modified. In certain embodiments, the modification(s) in each wing are the same. In certain embodiments, the modification(s) in one wing are different from the modification(s) in the other wing. In certain embodiments, short antisense compounds are gapmers having 2'-deoxynucleotides in the gap and nucleotides with high-affinity modifications in the wing.

As used herein, the term "prodrug" refers to a therapeutic agent that is prepared in an inactive form that is converted to an active form (i.e., drug) within the body or cells thereof by the action of endogenous enzymes or other chemicals and/or conditions.

As used herein, the term "pharmaceutically acceptable salts" refers to salts of active compounds that retain the desired biological activity of the active compound and do not impart undesired toxicological effects thereto.

As used herein, the term "cap structure" or "terminal cap moiety" refers to chemical modifications, which have been incorporated at either terminus of an antisense compound.

As used herein, the term "prevention" refers to delaying or forestalling the onset or development of a condition or disease for a period of time from hours to days, preferably weeks to months.

As used herein, the term "amelioration" refers to a lessening of at least one indicator of the severity of a condition or disease. The severity of indicators may be determined by subjective or objective measures which are known to those skilled in the art.

As used herein, the term "treatment" refers to administering a composition of the invention to effect an alteration or improvement of the disease or condition. Prevention, amelioration, and/or treatment may require administration of multiple doses at regular intervals, or prior to onset of the disease or condition to alter the course of the disease or condition. Moreover, a single agent may be used in a single individual for each prevention, amelioration, and treatment of a condition or disease sequentially, or concurrently.

As used herein, the term "pharmaceutical agent" refers to a substance provides a therapeutic benefit when administered to a subject.

As used herein, the term "therapeutically effective amount" refers to an amount of a pharmaceutical agent that provides a therapeutic benefit to an animal.

As used herein, "administering" means providing a pharmaceutical agent to an animal, and includes, but is not limited to administering by a medical professional and self-administering.

As used herein, the term "co-administration" refers to administration of two or more pharmaceutical agents to an animal. The two or more pharmaceutical agents may be in a single pharmaceutical composition, or may be in separate pharmaceutical compositions. Each of the two or more pharmaceutical agents may be administered through the same or different routes of administration. Co-administration encompasses administration in parallel or sequentially.

As used herein, the term "pharmaceutical composition" refers to a mixture of substances suitable for administering to an individual. For example, a pharmaceutical composition may comprise an antisense oligonucleotide and a sterile aqueous solution.

As used herein, the term "individual" refers to a human or non-human animal selected for treatment or therapy.

As used herein, the term "animal" refers to a human or non-human animal, including, but not limited to, mice, rats, rabbits, dogs, cats, pigs, and non-human primates, including, but not limited to, monkeys and chimpanzees.

As used herein, the term "subject" refers to an animal, including, but not limited to a human, to whom a pharmaceutical composition is administered.

As used herein, the term "duration" refers to the period of time during which an activity or event continues. In certain embodiments, the duration of treatment is the period of time during which doses of a pharmaceutical agent are administered.

As used herein, the term "parenteral administration," refers to administration through injection or infusion. Parenteral administration includes, but is not limited to, subcutaneous administration, intravenous administration, or intramuscular administration.

As used herein, the term "subcutaneous administration" refers to administration just below the skin. "Intravenous administration" means administration into a vein.

As used herein, the term "dose" refers to a specified quantity of a pharmaceutical agent provided in a single administration. In certain embodiments, a dose may be administered in two or more boluses, tablets, or injections. For example, in certain embodiments, where subcutaneous administration is desired, the desired dose requires a volume not easily accommodated by a single injection. In such embodiments, two or more injections may be used to achieve the desired dose. In certain embodiments, a dose may be administered in two or more injections to minimize injection site reaction in an individual.

As used herein, the term "dosage unit" refers to a form in which a pharmaceutical agent is provided. In certain embodiments, a dosage unit is a vial comprising lyophilized antisense oligonucleotide. In certain embodiments, a dosage unit is a vial comprising reconstituted antisense oligonucleotide.

As used herein, the term "pharmaceutical agent" refers to a substance provides a therapeutic benefit when administered to an individual. For example, in certain embodiments, an antisense oligonucleotide is a pharmaceutical agent.

As used herein, the term "active pharmaceutical ingredient" refers to the substance in a pharmaceutical composition that provides a desired effect.

As used herein, the term "therapeutically effective amount" refers to an amount of a pharmaceutical agent that provides a therapeutic benefit to an individual. In certain embodiments, a therapeutically effective amount of an antisense compound is the amount that needs to be administered to result in an observable benefit.

As used herein, the term "hypercholesterolemia" refers to a condition characterized by elevated serum cholesterol.

As used herein, the term "hyperlipidemia" refers to a condition characterized by elevated serum lipids.

As used herein, the term "hypertriglyceridemia" refers to a condition characterized by elevated triglyceride levels.

As used herein, the term "non-familial hypercholesterolemia" refers to a condition characterized by elevated cholesterol that is not the result of a single inherited gene mutation.

As used herein, the term "polygenic hypercholesterolemia" refers to a condition characterized by elevated cholesterol that results from the influence of a variety of genetic factors. In certain embodiments, polygenic hypercholesterolemia may be exacerbated by dietary intake of lipids.

As used herein, the term "familial hypercholesterolemia (FH)" refers to an autosomal dominant metabolic disorder characterized by a mutation in the LDL-receptor (LDL-R) gene, markedly elevated LDL-C and premature onset of atherosclerosis. A diagnosis of familial hypercholesterolemia is made when an individual meets one or more of the following criteria: genetic testing confirming 2 mutated LDL-receptor genes; genetic testing confirming one mutated LDL-receptor gene; document history of untreated serum LDL-cholesterol greater than 500 mg/dL; tendinous and/or cutaneous xanthoma prior to age 10 years; or, both parents have documented elevated serum LDL-cholesterol prior to lipid-lowering therapy consistent with heterozygous familial hypercholesterolemia.

As used herein, the term "homozygous familial hypercholesterolemia" or "HoFH" refers to a condition characterized by a mutation in both maternal and paternal LDL-R genes.

As used herein, the term "heterozygous familial hypercholesterolemia" or "HeFH" refers to a condition characterized by a mutation in either the maternal or paternal LDL-R gene.

As used herein, the term "mixed dyslipidemia" refers to a condition characterized by elevated serum cholesterol and elevated serum triglycerides.

As used herein, the term "diabetic dyslipidemia" or "Type II diabetes with dyslipidemia" refers to a condition characterized by Type II diabetes, reduced HDL-C, elevated serum triglycerides, and elevated small, dense LDL particles.

As used herein, the term "CHD risk equivalents," refers to indicators of clinical atherosclerotic disease that confer a high risk for coronary heart disease. For example, in certain embodiments, CHD risk equivalents include, without limitation, clinical coronary heart disease, symptomatic carotid artery disease, peripheral arterial disease, and/or abdominal aortic aneurysm.

As used herein, the term "non-alcoholic fatty liver disease (NAFLD)" refers to a condition characterized by fatty inflammation of the liver that is not due to excessive alcohol use (for example, alcohol consumption of over 20 g/day). In certain embodiments, NAFLD is related to insulin resistance and the metabolic syndrome.

As used herein, the term "non-alcoholic steatohepatitis (NASH)" refers to a condition characterized by inflammation and the accumulation of fat and fibrous tissue in the liver, that is not due to excessive alcohol use. NASH is an extreme form of NAFLD.

As used herein, the term "major risk factors" refers to factors that contribute to a high risk for a particular disease or condition. In certain embodiments, major risk factors for coronary heart disease include, without limitation, cigarette smoking, hypertension, low HDL-C, family history of coronary heart disease, and age.

As used herein, the term "CHD risk factors" refers to CHD risk equivalents and major risk factors.

As used herein, the term "coronary heart disease (CHD)" refers to a narrowing of the small blood vessels that supply blood and oxygen to the heart, which is often a result of atherosclerosis.

As used herein, the term "reduced coronary heart disease risk" refers to a reduction in the likelihood that a individual will develop coronary heart disease. In certain embodiments, a reduction in coronary heart disease risk is measured by an improvement in one or more CHD risk factors, for example, a decrease in LDL-C levels.

As used herein, the term "atherosclerosis" refers to a hardening of the arteries affecting large and medium-sized arteries and is characterized by the presence of fatty deposits. The fatty deposits are called "atheromas" or "plaques," which consist mainly of cholesterol and other fats, calcium and scar tissue, and damage the lining of arteries.

As used herein, the term "history of coronary heart disease" refers to the occurrence of clinically evident coronary heart disease in the medical history of a individual or a individual's family member.

As used herein, the term "Early onset coronary heart disease" refers to a diagnosis of coronary heart disease prior to age 50.

As used herein, the term "statin intolerant individual" refers to a individual who as a result of statin therapy experiences one or more of creatine kinase increases, liver function test abnormalities, muscle aches, or central nervous system side effects.

As used herein, the term "efficacy" refers to the ability to produce a desired effect. For example, efficacy of a lipid-lowering therapy may be reduction in the concentration of one or more of LDL-C, VLDL-C, IDL-C, non-HDL-C, ApoB, lipoprotein(a), or triglycerides.

As used herein, the term "acceptable safety profile" refers to a pattern of side effects that is within clinically acceptable limits.

As used herein, the term "side effects" refers to physiological responses attributable to a treatment other than desired effects. In certain embodiments, side effects include, without limitation, injection site reactions, liver function test abnormalities, renal function abnormalities, liver toxicity, renal toxicity, central nervous system abnormalities, and myopathies. For example, increased aminotransferase levels in serum may indicate liver toxicity or liver function abnormality. For example, increased bilirubin may indicate liver toxicity or liver function abnormality.

As used herein, the term "injection site reaction" refers to inflammation or abnormal redness of skin at a site of injection in an individual.

As used herein, the term "individual compliance" refers to adherence to a recommended or prescribed therapy by an individual.

As used herein, the term "lipid-lowering therapy" refers to a therapeutic regimen provided to a individual to reduce one or more lipids in a individual. In certain embodiments, a lipid-lowering therapy is provide to reduce one or more of ApoB, total cholesterol, LDL-C, VLDL-C, IDL-C, non-HDL-C, triglycerides, small dense LDL particles, and Lp(a) in an individual.

As used herein, the term "lipid-lowering agent" refers to a pharmaceutical agent provided to a individual to achieve a lowering of lipids in the individual. For example, in certain embodiments, a lipid-lowering agent is provided to an individual to reduce one or more of ApoB, LDL-C, total cholesterol, and triglycerides.

As used herein, the term "LDL-C target" refers to an LDL-C level that is desired following lipid-lowering therapy.

As used herein, the term "comply" refers to the adherence with a recommended therapy by an individual.

As used herein, the term "recommended therapy" refers to a therapeutic regimen recommended by a medical professional for the treatment, amelioration, or prevention of a disease.

As used herein, the term "low LDL-receptor activity" refers to LDL-receptor activity that is not sufficiently high to maintain clinically acceptable levels of LDL-C in the bloodstream.

As used herein, the term "cardiovascular outcome" refers to the occurrence of major adverse cardiovascular events.

As used herein, the term "improved cardiovascular outcome" refers to a reduction in the occurrence of major adverse cardiovascular events, or the risk thereof. Examples of major adverse cardiovascular events include, without limitation, death, reinfarction, stroke, cardiogenic shock, pulmonary edema, cardiac arrest, and atrial dysrhythmia.

As used herein, the term "surrogate markers of cardiovascular outcome" refers to indirect indicators of cardiovascular events, or the risk thereof. For example, surrogate markers of cardiovascular outcome include carotid intimal media thickness (CIMT). Another example of a surrogate marker of cardiovascular outcome includes atheroma size. Atheroma size may be determined by intravascular ultrasound (IVUS).

As used herein, the term "increased HDL-C" refers to an increase in serum HDL-C in an individual over time.

As used herein, the term "lipid-lowering" refers to a reduction in one or more serum lipids in an individual over time.

As used herein, the term "metabolic disorder" refers to a condition characterized by an alteration or disturbance in metabolic function. "Metabolic" and "metabolism" are terms well know in the art and generally include the whole range of biochemical processes that occur within a living organism. Metabolic disorders include, but are not limited to, hyperglycemia, prediabetes, diabetes (type I and type II), obesity, insulin resistance and metabolic syndrome.

As used herein, the term "metabolic syndrome" refers to a clustering of lipid and non-lipid cardiovascular risk factors of metabolic origin. It has been closely linked to the generalized metabolic disorder known as insulin resistance. The National Cholesterol Education Program (NCEP) Adult Treatment Panel III (ATPIII) established criteria for diagnosis of metabolic syndrome when three or more of five risk determinants are present. The five risk determinants are abdominal obesity defined as waist circumference of greater than 102 cm for men or greater than 88 cm for women, triglyceride levels greater than or equal to 150 mg/dL, HDL cholesterol levels of less than 40 mg/dL for men and less than 50 mg/dL for women, blood pressure greater than or equal to 130/85 mm Hg and fasting glucose levels greater than or equal to 110 mg/dL. These determinants can be readily measured in clinical practice (JAMA, 2001, 285: 2486-2497).

The term "alkyl," as used herein, refers to a saturated straight or branched hydrocarbon radical containing up to twenty four carbon atoms. Examples of alkyl groups include, but are not limited to, methyl, ethyl, propyl, butyl, isopropyl, n-hexyl, octyl, decyl, dodecyl and the like. Alkyl groups typically include from 1 to about 24 carbon atoms, more typically from 1 to about 12 carbon atoms ($C_1$-$C_{12}$ alkyl) with from 1 to about 6 carbon atoms being more preferred. The term "lower alkyl" as used herein includes from 1 to about 6 carbon atoms. Alkyl groups as used herein may optionally include one or more further substituent groups.

The term "alkenyl," as used herein, refers to a straight or branched hydrocarbon chain radical containing up to twenty four carbon atoms and having at least one carbon-carbon double bond. Examples of alkenyl groups include, but are not limited to, ethenyl, propenyl, butenyl, 1-methyl-2-buten-1-yl, dienes such as 1,3-butadiene and the like. Alkenyl groups typically include from 2 to about 24 carbon atoms, more typically from 2 to about 12 carbon atoms with from 2 to about 6 carbon atoms being more preferred. Alkenyl groups as used herein may optionally include one or more further substituent groups.

The term "alkynyl," as used herein, refers to a straight or branched hydrocarbon radical containing up to twenty four carbon atoms and having at least one carbon-carbon triple bond. Examples of alkynyl groups include, but are not limited to, ethynyl, 1-propynyl, 1-butynyl, and the like. Alkynyl groups typically include from 2 to about 24 carbon atoms, more typically from 2 to about 12 carbon atoms with from 2 to about 6 carbon atoms being more preferred. Alkynyl groups as used herein may optionally include one or more further substituent groups.

The term "aminoalkyl" as used herein, refers to an amino substituted alkyl radical. This term is meant to include $C_1$-$C_{12}$ alkyl groups having an amino substituent at any position and wherein the alkyl group attaches the aminoalkyl group to the parent molecule. The alkyl and/or amino portions of the aminoalkyl group can be further substituted with substituent groups.

The term "aliphatic," as used herein, refers to a straight or branched hydrocarbon radical containing up to twenty four carbon atoms wherein the saturation between any two carbon atoms is a single, double or triple bond. An aliphatic group preferably contains from 1 to about 24 carbon atoms, more typically from 1 to about 12 carbon atoms with from 1 to about 6 carbon atoms being more preferred. The straight or branched chain of an aliphatic group may be interrupted with one or more heteroatoms that include nitrogen, oxygen, sulfur and phosphorus. Such aliphatic groups interrupted by heteroatoms include without limitation polyalkoxys, such as polyalkylene glycols, polyamines, and polyimines. Aliphatic groups as used herein may optionally include further substitutent groups.

The term "alicyclic" or "alicyclyl" refers to a cyclic ring system wherein the ring is aliphatic. The ring system can comprise one or more rings wherein at least one ring is aliphatic. Preferred alicyclics include rings having from about 5 to about 9 carbon atoms in the ring. Alicyclic as used herein may optionally include further substituent groups.

The term "alkoxy," as used herein, refers to a radical formed between an alkyl group and an oxygen atom wherein the oxygen atom is used to attach the alkoxy group to a parent molecule. Examples of alkoxy groups include, but are not limited to, methoxy, ethoxy, propoxy, isopropoxy, n-butoxy, sec-butoxy, tert-butoxy, n-pentoxy, neopentoxy, n-hexoxy and the like. Alkoxy groups as used herein may optionally include further substitutent groups.

The terms "halo" and "halogen," as used herein, refer to an atom selected from fluorine, chlorine, bromine and iodine.

The terms "aryl" and "aromatic," as used herein, refer to a mono- or polycyclic carbocyclic ring system radicals having one or more aromatic rings. Examples of aryl groups include, but are not limited to, phenyl, naphthyl, tetrahydronaphthyl, indanyl, idenyl and the like. Preferred aryl ring systems have from about 5 to about 20 carbon atoms in one or more rings. Aryl groups as used herein may optionally include further substitutent groups.

The terms "aralkyl" and "arylalkyl," as used herein, refer to a radical formed between an alkyl group and an aryl group wherein the alkyl group is used to attach the aralkyl group to a parent molecule. Examples include, but are not limited to, benzyl, phenethyl and the like. Aralkyl groups as used herein may optionally include further substitutent groups attached to the alkyl, the aryl or both groups that form the radical group.

The term "heterocyclic radical" as used herein, refers to a radical mono-, or poly-cyclic ring system that includes at least one heteroatom and is unsaturated, partially saturated or fully saturated, thereby including heteroaryl groups. Heterocyclic is also meant to include fused ring systems wherein one or more of the fused rings contain at least one heteroatom and the other rings can contain one or more heteroatoms or optionally contain no heteroatoms. A heterocyclic group typically includes at least one atom selected from sulfur, nitrogen or oxygen. Examples of heterocyclic groups include, [1,3] dioxolane, pyrrolidinyl, pyrazolinyl, pyrazolidinyl, imidazolinyl, imidazolidinyl, piperidinyl, piperazinyl, oxazolidinyl, isoxazolidinyl, morpholinyl, thiazolidinyl, isothiazolidinyl, quinoxalinyl, pyridazinonyl, tetrahydrofuryl and the like. Heterocyclic groups as used herein may optionally include further substitutent groups.

The terms "heteroaryl," and "heteroaromatic," as used herein, refer to a radical comprising a mono- or poly-cyclic aromatic ring, ring system or fused ring system wherein at least one of the rings is aromatic and includes one or more heteroatom. Heteroaryl is also meant to include fused ring systems including systems where one or more of the fused rings contain no heteroatoms. Heteroaryl groups typically include one ring atom selected from sulfur, nitrogen or oxygen. Examples of heteroaryl groups include, but are not limited to, pyridinyl, pyrazinyl, pyrimidinyl, pyrrolyl, pyrazolyl, imidazolyl, thiazolyl, oxazolyl, isooxazolyl, thiadiazolyl, oxadiazolyl, thiophenyl, furanyl, quinolinyl, isoquinolinyl, benzimidazolyl, benzooxazolyl, quinoxalinyl, and the like. Heteroaryl radicals can be attached to a parent molecule directly or through a linking moiety such as an aliphatic group or hetero atom. Heteroaryl groups as used herein may optionally include further substitutent groups.

The term "heteroarylalkyl," as used herein, refers to a heteroaryl group as previously defined having an alky radical that can attach the heteroarylalkyl group to a parent molecule. Examples include, but are not limited to, pyridinylmethyl, pyrimidinylethyl, napthyridinylpropyl and the like. Heteroarylalkyl groups as used herein may optionally include further substitutent groups on one or both of the heteroaryl or alkyl portions.

The term "mono or poly cyclic structure" as used in the present invention includes all ring systems that are single or polycyclic having rings that are fused or linked and is meant to be inclusive of single and mixed ring systems individually selected from aliphatic, alicyclic, aryl, heteroaryl, aralkyl, arylalkyl, heterocyclic, heteroaryl, heteroaromatic, heteroarylalkyl. Such mono and poly cyclic structures can contain rings that are uniform or have varying degrees of saturation including fully saturated, partially saturated or fully unsaturated. Each ring can comprise ring atoms selected from C, N, O and S to give rise to heterocyclic rings as well as rings comprising only C ring atoms which can be present in a mixed motif such as for example benzimidazole wherein one ring has only carbon ring atoms and the fused ring has two nitrogen atoms. The mono or poly cyclic structures can be further substituted with substituent groups such as for example phthalimide which has two =O groups attached to one of the rings. In another aspect, mono or poly cyclic structures can be attached to a parent molecule directly through a ring atom, through a substituent group or a bifunctional linking moiety.

The term "acyl," as used herein, refers to a radical formed by removal of a hydroxyl group from an organic acid and has the general formula —C(O)—X where X is typically aliphatic, alicyclic or aromatic. Examples include aliphatic carbonyls, aromatic carbonyls, aliphatic sulfonyls, aromatic sulfinyls, aliphatic sulfinyls, aromatic phosphates, aliphatic phosphates and the like. Acyl groups as used herein may optionally include further substitutent groups.

The term "hydrocarbyl" includes groups comprising C, O and H. Included are straight, branched and cyclic groups having any degree of saturation. Such hydrocarbyl groups can include one or more heteroatoms selected from N, O and S and can be further mono or poly substituted with one or more substituent groups.

The terms "substituent" and "substituent group," as used herein, include groups that are typically added to other groups or parent compounds to enhance desired properties or give desired effects. Substituent groups can be protected or unprotected and can be added to one available site or to many available sites in a parent compound. Substituent groups may also be further substituted with other substituent groups and may be attached directly or via a linking group such as an alkyl or hydrocarbyl group to a parent compound. Such groups include without limitation, halogen, hydroxyl, alkyl, alkenyl, alkynyl, acyl (—C(O)R$_{aa}$), carboxyl (—C(O)O—R$_{aa}$), aliphatic groups, alicyclic groups, alkoxy, substituted oxo (—O—R$_{aa}$), aryl, aralkyl, heterocyclic, heteroaryl, heteroarylalkyl, amino (—NR$_{bb}$R$_{cc}$), imino(=NR$_{bb}$), amido (—C(O)NR$_{bb}$R$_{cc}$ or —N(R$_{bb}$)C(O)R$_{aa}$), azido (—N$_3$), nitro (—NO$_2$), cyano (—CN), carbamido (—OC(O)NR$_{bb}$R$_{cc}$ or —N(R$_{bb}$)C(O)OR$_{aa}$), ureido (—N(R$_{bb}$)C(O)NR$_{bb}$R$_{cc}$), thioureido (—N(R$_{bb}$)C(S)NR$_{bb}$R$_{cc}$), guanidinyl (—N(R$_{bb}$)C(=NR$_{bb}$)NR$_{bb}$R$_{cc}$), amidinyl (—C(=NR$_{bb}$)NR$_{bb}$R$_{cc}$ or —N(R$_{bb}$)C(NR$_{bb}$)R$_{aa}$), thiol (—SR$_{bb}$), sulfinyl (—S(O)R$_{bb}$), sulfonyl (—S(O)$_2$R$_{bb}$), sulfonamidyl (—S(O)$_2$NR$_{bb}$R$_{cc}$ or —N(R$_{bb}$)S(O)$_2$R$_{bb}$) and conjugate groups. Wherein each R$_{aa}$, R$_{bb}$ and R$_{cc}$ is, independently, H, an optionally linked chemical functional group or a further substituent group with a preferred list including without limitation H, alkyl, alkenyl, alkynyl, aliphatic, alkoxy, acyl, aryl, aralkyl, heteroaryl, alicyclic, heterocyclic and heteroarylalkyl.

B. CERTAIN OLIGOMERIC COMPOUNDS

In certain embodiments, it is desirable to chemically modify oligomeric compounds, compared to naturally occurring oligomers, such as DNA or RNA. Certain such modifications alter the activity of the oligomeric compound. Certain such chemical modifications can alter activity by, for example: increasing affinity of an antisense compound for its target nucleic acid, increasing its resistance to one or more nucleases, and/or altering the pharmacokinetics or tissue distribution of the oligomeric compound. In certain instances, the use of chemistries that increase the affinity of an oligomeric compound for its target can allow for the use of shorter oligomeric compounds.

1. Certain Monomers

In certain embodiment, oligomeric compounds comprise one or more modified monomer. In certain such embodiments, oligomeric compounds comprise one or more high affinity monomer. In certain embodiments, such high-affinity monomer is selected from monomers (e.g., nucleosides and nucleotides) comprising 2'-modified sugars, including, but not limited to: BNA's and monomers (e.g., nucleosides and nucleotides) with 2'-substituents such as allyl, amino, azido, thio, O-allyl, O—C$_1$-C$_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), or O—CH$_2$—C(=O)—N(R$_m$)(R$_n$), where each R$_m$ and R$_n$ is, independently, H or substituted or unsubstituted C$_1$-C$_{10}$ alkyl.

In certain embodiments, the oligomeric compounds including, but no limited to short antisense compounds of the present invention, comprise one or more high affinity monomers provided that the oligomeric compound does not comprise a nucleotide comprising a 2'-O(CH$_2$)$_n$H, wherein n is one to six.

In certain embodiments, the oligomeric compounds including, but no limited to short antisense compounds of the present invention, comprise one or more high affinity monomer provided that the oligomeric compound does not comprise a nucleotide comprising a 2'-OCH$_3$ or a 2'-O(CH$_2$)$_2$OCH$_3$.

In certain embodiments, the oligomeric compounds including, but no limited to short antisense compounds of the present invention, comprise one or more high affinity monomer provided that the oligomeric compound does not comprise a α-L-Methyleneoxy (4'-CH$_2$—O-2') BNA.

In certain embodiments, the oligomeric compounds including, but no limited to short antisense compounds of the present invention, comprise one or more high affinity monomer provided that the oligomeric compound does not comprise a β-D-Methyleneoxy (4'-CH$_2$—O-2') BNA.

In certain embodiments, the oligomeric compounds including, but no limited to short antisense compounds of the present invention, comprise one or more high affinity monomer provided that the oligomeric compound does not comprise a α-L-Methyleneoxy (4'-CH$_2$—O-2') BNA or a β-D-Methyleneoxy (4'-CH$_2$—O-2') BNA.

a. Certain Nucleobases

The naturally occurring base portion of a nucleoside is typically a heterocyclic base. The two most common classes of such heterocyclic bases are the purines and the pyrimidines. For those nucleosides that include a pentofuranosyl sugar, a phosphate group can be linked to the 2', 3' or 5' hydroxyl moiety of the sugar. In forming oligonucleotides, those phosphate groups covalently link adjacent nucleosides to one another to form a linear polymeric compound. Within oligonucleotides, the phosphate groups are commonly referred to as forming the internucleotide backbone of the oligonucleotide. The naturally occurring linkage or backbone of RNA and of DNA is a 3' to 5' phosphodiester linkage.

In addition to "unmodified" or "natural" nucleobases such as the purine nucleobases adenine (A) and guanine (G), and the pyrimidine nucleobases thymine (T), cytosine (C) and uracil (U), many modified nucleobases or nucleobase mimetics known to those skilled in the art are amenable with the compounds described herein. In certain embodiments, a modified nucleobase is a nucleobase that is fairly similar in structure to the parent nucleobase, such as for example a 7-deaza purine, a 5-methyl cytosine, or a G-clamp. In certain embodiments, nucleobase mimetic include more complicated structures, such as for example a tricyclic phenoxazine nucleobase mimetic. Methods for preparation of the above noted modified nucleobases are well known to those skilled in the art.

b. Certain Sugars

Oligomeric compounds provided herein may comprise one or more monomer, including a nucleoside or nucleotide, having a modified sugar moiety. For example, the furanosyl sugar ring of a nucleoside can be modified in a number of ways including, but not limited to, addition of a substituent group, bridging of two non-geminal ring atoms to form a bicyclic nucleic acid (BNA).

In certain embodiments, oligomeric compounds comprise one or more monomers that is a BNA. In certain such embodiments, BNA s include, but are not limited to, (A) α-L-Methyleneoxy (4'-CH$_2$—O-2') BNA, (B) β-D-Methyleneoxy (4'-CH$_2$—O-2') BNA, (C) Ethyleneoxy (4'-(CH$_2$)$_2$—O-2') BNA, (D) Aminooxy (4'-CH$_2$—O—N(R)-2') BNA and (E) Oxyamino (4'-CH$_2$—N(R)—O-2') BNA, as depicted in Figure 1.

FIG. 1. Certain BNA Structures

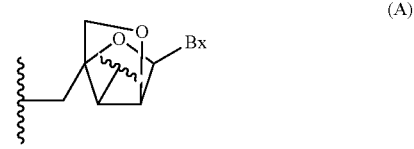

(A)

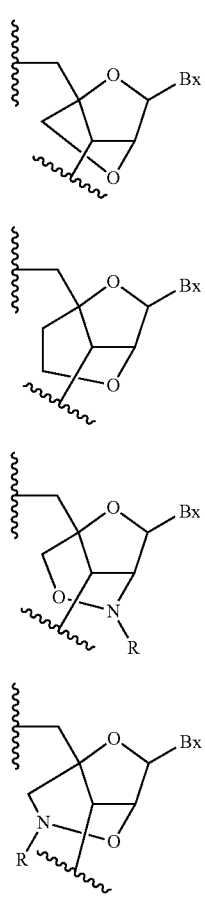

In certain embodiments, BNA compounds include, but are not limited to, compounds having at least one bridge between the 4' and the 2' position of the sugar wherein each of the bridges independently comprises 1 or from 2 to 4 linked groups independently selected from —[C($R_1$)($R_2$)]$_n$—, —C($R_1$)=C($R_2$)—, —C($R_1$)=N—, —C(=N$R_1$)—, —C(=O)—, —C(=S)—, —O—, —Si($R_1$)$_2$—, —S(=O)$_x$— and —N($R_1$)—;

wherein:

x is 0, 1, or 2;

n is 1, 2, 3, or 4;

each $R_1$ and $R_2$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, O$J_1$, N$J_1J_2$, S$J_1$, $N_3$, COO$J_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl or a protecting group.

In one embodiment, each of the bridges of the BNA compounds is, independently, —[C($R_1$)($R_2$)]$_n$—, —[C($R_1$)($R_2$)]$_n$—O—, —C($R_1R_2$)—N($R_1$)—O— or —C($R_1R_2$)—O—N($R_1$)—. In another embodiment, each of said bridges is, independently, 4'-CH$_2$-2',4'-(CH$_2$)$_{2-2'}$,4'-(CH$_2$)$_{3-2'}$,4'-CH$_2$—O-2', 4'-(CH$_2$)$_2$—O-2',4'-CH$_2$—O—N($R_1$)-2' and 4'-CH$_2$—N($R_1$)—O-2'- wherein each $R_1$ is, independently, H, a protecting group or $C_1$-$C_{12}$ alkyl.

Certain BNA's have been prepared and disclosed in the patent literature as well as in scientific literature (Singh et al., Chem. Commun., 1998, 4, 455-456; Koshkin et al., Tetrahedron, 1998, 54, 3607-3630; Wahlestedt et al., Proc. Natl. Acad. Sci. U.S.A., 2000, 97, 5633-5638; Kumar et al., Bioorg. Med. Chem. Lett., 1998, 8, 2219-2222; WO 94/14226; WO 2005/021570; Singh et al., J. Org. Chem., 1998, 63, 10035-10039; Examples of issued US patents and published applications that disclose BNA s include, for example, U.S. Pat. Nos. 7,053,207; 6,268,490; 6,770,748; 6,794,499; 7,034,133; and 6,525,191; and U.S. Pre-Grant Publication Nos. 2004-0171570; 2004-0219565; 2004-0014959; 2003-0207841; 2004-0143114; and 20030082807.

Also provided herein are BNAs in which the 2'-hydroxyl group of the ribosyl sugar ring is linked to the 4' carbon atom of the sugar ring thereby forming a methyleneoxy (4'-CH$_2$—O-2') linkage to form the bicyclic sugar moiety (reviewed in Elayadi et al., Curr. Opinion Invens. Drugs, 2001, 2, 558-561; Braasch et al., Chem. Biol., 2001, 8 1-7; and Orum et al., Curr. Opinion Mol. Ther., 2001, 3, 239-243; see also U.S. Pat. Nos. 6,268,490 and 6,670,461). The linkage can be a methylene (—CH$_2$—) group bridging the 2' oxygen atom and the 4' carbon atom, for which the term methyleneoxy (4'-CH$_2$—O-2') BNA is used for the bicyclic moiety; in the case of an ethylene group in this position, the term ethyleneoxy (4'-CH$_2$CH$_2$—O-2') BNA is used (Singh et al., Chem. Commun., 1998, 4, 455-456: Morita et al., Bioorganic Medicinal Chemistry, 2003, 11, 2211-2226). Methyleneoxy (4'-CH$_2$—O-2') BNA and other bicyclic sugar analogs display very high duplex thermal stabilities with complementary DNA and RNA (Tm=+3 to +10° C.), stability towards 3'-exonucleolytic degradation and good solubility properties. Potent and non-toxic antisense oligonucleotides comprising BNAs have been described (Wahlestedt et al., Proc. Natl. Acad. Sci. U.S.A., 2000, 97, 5633-5638).

An isomer of methyleneoxy (4'-CH$_2$—O-2') BNA that has also been discussed is alpha-L-methyleneoxy (4'-CH$_2$—O-2') BNA which has been shown to have superior stability against a 3'-exonuclease. The alpha-L-methyleneoxy (4'-CH$_2$—O-2') BNA's were incorporated into antisense gapmers and chimeras that showed potent antisense activity (Frieden et al., Nucleic Acids Research, 2003, 21, 6365-6372).

The synthesis and preparation of the methyleneoxy (4'-CH$_2$—O-2') BNA monomers adenine, cytosine, guanine, 5-methyl-cytosine, thymine and uracil, along with their oligomerization, and nucleic acid recognition properties have been described (Koshkin et al., Tetrahedron, 1998, 54, 3607-3630). BNAs and preparation thereof are also described in WO 98/39352 and WO 99/14226.

Analogs of methyleneoxy (4'-CH$_2$—O-2') BNA, phosphorothioate-methyleneoxy (4'-CH$_2$—O-2') BNA and 2'-thio-BNAs, have also been prepared (Kumar et al., Bioorg. Med. Chem. Lett., 1998, 8, 2219-2222). Preparation of locked nucleoside analogs comprising oligodeoxyribonucleotide duplexes as substrates for nucleic acid polymerases has also been described (Wengel et al., WO 99/14226). Furthermore, synthesis of 2'-amino-BNA, a novel conformationally restricted high-affinity oligonucleotide analog has been described in the art (Singh et al., J. Org. Chem., 1998, 63, 10035-10039). In addition, 2'-Amino- and 2'-methylamino- BNA's have been prepared and the thermal stability of their duplexes with complementary RNA and DNA strands has been previously reported.

Modified sugar moieties are well known and can be used to alter, typically increase, the affinity of the antisense compound for its target and/or increase nuclease resistance. A representative list of preferred modified sugars includes but is not limited to bicyclic modified sugars (BNA's), including methyleneoxy (4'-CH$_2$—O-2') BNA and ethyleneoxy (4'-(CH$_2$)$_2$—O-2' bridge) BNA; substituted sugars, especially 2'-substituted sugars having a 2'-F, 2'-OCH$_3$ or a 2'-O(CH$_2$)$_2$—OCH$_3$ substituent group; and 4'-thio modified sugars. Sugars can also be replaced with sugar mimetic groups among others. Methods for the preparations of modified sugars are well known to those skilled in the art. Some representative patents and publications that teach the preparation of such modified sugars include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; 5,792,747; 5,700,920; 6,531,584; and 6,600,032; and WO 2005/121371.

In certain embodiments, BNA's include bicyclic nucleoside having the formula:

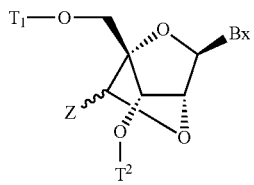

wherein:

Bx is a heterocyclic base moiety;

T$_1$ is H or a hydroxyl protecting group;

T$_2$ is H, a hydroxyl protecting group or a reactive phosphorus group;

Z is C$_1$-C$_6$ alkyl, C$_2$-C$_6$ alkenyl, C$_2$-C$_6$ alkynyl, substituted C$_1$-C$_6$ alkyl, substituted C$_2$-C$_6$ alkenyl, substituted C$_2$-C$_6$ alkynyl, acyl, substituted acyl, or substituted amide.

In one embodiment, each of the substituted groups, is, independently, mono or poly substituted with optionally protected substituent groups independently selected from halogen, oxo, hydroxyl, OJ$_1$, NJ$_1$J$_2$, SJ$_1$, N$_3$, OC(=X)J$_1$, OC(=X)NJ$_3$J$_2$, NJ$_3$C(=X)NJ$_1$J$_2$ and CN, wherein each J$_1$, J$_2$ and J$_3$ is, independently, H or C$_1$-C$_6$ alkyl, and X is O, S or NJ$_1$.

In certain such embodiments, each of the substituted groups, is, independently, mono or poly substituted with substituent groups independently selected from halogen, oxo, hydroxyl, OJ$_1$, NJ$_1$J$_2$, SJ$_1$, N$_3$, OC(=X)J$_1$, and NJ$_3$C(=X)NJ$_1$J$_2$, wherein each J$_1$, J$_2$ and J$_3$ is, independently, H, C$_1$-C$_6$ alkyl, or substituted C$_1$-C$_6$ alkyl and X is O or NJ$_1$.

In certain embodiments, the Z group is C$_1$-C$_6$ alkyl substituted with one or more X$^x$, wherein each X$^x$ is independently OJ$_1$, NJ$_1$J$_2$, SJ$_1$, N$_3$, OC(=X)J$_1$, OC(=X)NJ$_1$J$_2$, NJ$_3$C(=X)NJ$_1$J$_2$ or CN; wherein each J$_1$, J$_2$ and J$_3$ is, independently, H or C$_1$-C$_6$ alkyl, and X is O, S or NJ$_1$. In another embodiment, the Z group is C$_1$-C$_6$ alkyl substituted with one or more X$^x$, wherein each X$^x$ is independently halo (e.g., fluoro), hydroxyl, alkoxy (e.g., CH$_3$O—), substituted alkoxy or azido.

In certain embodiments, the Z group is —CH$_2$X$^x$, wherein X$^x$ is OJ$_1$, NJ$_1$J$_2$, SJ$_1$, N$_3$, OC(=X)J$_1$, OC(=X)NJ$_1$J$_2$, NJ$_3$C(=X)NJ$_3$J$_2$ or CN; wherein each J$_3$, J$_2$ and J$_3$ is, independently, H or C$_1$-C$_6$ alkyl, and X is O, S or NJ$_1$. In another embodiment, the Z group is CH$_2$X$^x$, wherein X$^x$ is halo (e.g., fluoro), hydroxyl, alkoxy (e.g., CH$_3$O—) or azido.

In certain such embodiments, the Z group is in the (R)-configuration:

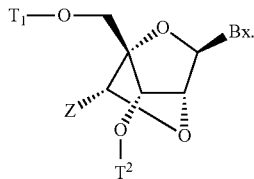

In certain such embodiments, the Z group is in the (S)-configuration:

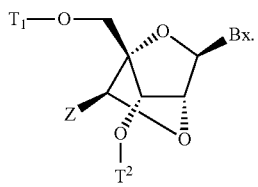

In certain embodiments, each T$_1$ and T$_2$ is a hydroxyl protecting group. A preferred list of hydroxyl protecting groups includes benzyl, benzoyl, 2,6-dichlorobenzyl, t-butyldimethylsilyl, t-butyldiphenylsilyl, mesylate, tosylate, dimethoxytrityl (DMT), 9-phenylxanthine-9-yl (Pixyl) and 9-(p-methoxyphenyl)xanthine-9-yl (MOX). In certain embodiments, T$_1$ is a hydroxyl protecting group selected from acetyl, benzyl, t-butyldimethylsilyl, t-butyldiphenylsilyl and dimethoxytrityl wherein a more preferred hydroxyl protecting group is T$_1$ is 4,4'-dimethoxytrityl.

In certain embodiments, T$_2$ is a reactive phosphorus group wherein preferred reactive phosphorus groups include diisopropylcyanoethoxy phosphoramidite and H-phosphonate. In certain embodiments T$_1$ is 4,4'-dimethoxytrityl and T$_2$ is diisopropylcyanoethoxy phosphoramidite.

In certain embodiments, oligomeric compounds have at least one monomer of the formula:

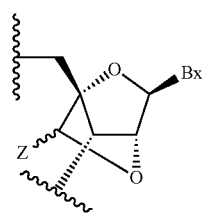

or of the formula:

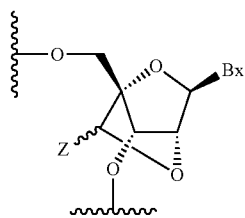

or of the formula:

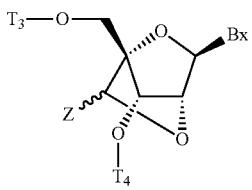

wherein

Bx is a heterocyclic base moiety;

$T_3$ is H, a hydroxyl protecting group, a linked conjugate group or an internucleoside linking group attached to a nucleoside, a nucleotide, an oligonucleotide, an oligonucleotide, a monomeric subunit or an oligomeric compound;

$T_4$ is H, a hydroxyl protecting group, a linked conjugate group or an internucleoside linking group attached to a nucleoside, a nucleotide, an oligonucleotide, an oligonucleotide, a monomeric subunit or an oligomeric compound;

wherein at least one of $T_3$ and $T_4$ is an internucleoside linking group attached to a nucleoside, a nucleotide, an oligonucleotide, an oligonucleotide, a monomeric subunit or an oligomeric compound; and Z is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, or substituted amide.

In one embodiment, each of the substituted groups, is, independently, mono or poly substituted with optionally protected substituent groups independently selected from halogen, oxo, hydroxyl, $OJ_1$, $NJ_1J_2$, $SJ_1$, $N_3$, $OC(=X)J_1$, $OC(=X)NJ_1J_2$, $NJ_3C(=X)NJ_1J_2$ and CN, wherein each $J_1$, $J_2$ and $J_3$ is, independently, H or $C_1$-$C_6$ alkyl, and X is O, S or $NJ_1$.

In one embodiment, each of the substituted groups, is, independently, mono or poly substituted with substituent groups independently selected from halogen, oxo, hydroxyl, $OJ_1$, $NJ_1J_2$, $SJ_1$, $N_3$, $OC(=X)J_1$, and $NJ_3C(=X)NJ_1J_2$, wherein each $J_1$, $J_2$ and $J_3$ is, independently, H or $C_1$-$C_6$ alkyl, and X is O or $NJ_1$.

In certain such embodiments, at least one Z is $C_1$-$C_6$ alkyl or substituted $C_1$-$C_6$ alkyl. In certain embodiments, each Z is, independently, $C_1$-$C_6$ alkyl or substituted $C_1$-$C_6$ alkyl. In certain embodiments, at least one Z is $C_1$-$C_6$ alkyl. In certain embodiments, each Z is, independently, $C_1$-$C_6$ alkyl. In certain embodiments, at least one Z is methyl. In certain embodiments, each Z is methyl. In certain embodiments, at least one Z is ethyl. In certain embodiments, each Z is ethyl. In certain embodiments, at least one Z is substituted $C_1$-$C_6$ alkyl. In certain embodiments, each Z is, independently, substituted $C_1$-$C_6$ alkyl. In certain embodiments, at least one Z is substituted methyl. In certain embodiments, each Z is substituted methyl. In certain embodiments, at least one Z is substituted ethyl. In certain embodiments, each Z is substituted ethyl.

In certain embodiments, at least one substituent group is $C_1$-$C_6$ alkoxy (e.g., at least one Z is $C_1$-$C_6$ alkyl substituted with one or more $C_1$-$C_6$ alkoxy). In another embodiment, each substituent group is, independently, $C_1$-$C_6$ alkoxy (e.g., each Z is, independently, $C_1$-$C_6$ alkyl substituted with one or more $C_1$-$C_6$ alkoxy).

In certain embodiments, at least one $C_1$-$C_6$ alkoxy substituent group is $CH_3O$— (e.g., at least one Z is $CH_3OCH_2$—). In another embodiment, each $C_1$-$C_6$ alkoxy substituent group is $CH_3O$— (e.g., each Z is $CH_3OCH_2$—).

In certain embodiments, at least one substituent group is halogen (e.g., at least one Z is $C_1$-$C_6$ alkyl substituted with one or more halogen). In certain embodiments, each substituent group is, independently, halogen (e.g., each Z is, independently, $C_1$-$C_6$ alkyl substituted with one or more halogen). In certain embodiments, at least one halogen substituent group is fluoro (e.g., at least one Z is $CH_2FCH_2$—, $CHF_2CH_2$— or $CF_3CH_2$—). In certain embodiments, each halo substituent group is fluoro (e.g., each Z is, independently, $CH_2FCH_2$—, $CHF_2CH_2$— or $CF_3CH_2$—).

In certain embodiments, at least one substituent group is hydroxyl (e.g., at least one Z is $C_1$-$C_6$ alkyl substituted with one or more hydroxyl). In certain embodiments, each substituent group is, independently, hydroxyl (e.g., each Z is, independently, $C_1$-$C_6$ alkyl substituted with one or more hydroxyl). In certain embodiments, at least one Z is $HOCH_2$—. In another embodiment, each Z is $HOCH_2$—.

In certain embodiments, at least one Z is $CH_3$—, $CH_3CH_2$—, $CH_2OCH_3$—, $CH_2F$— or $HOCH_2$—. In certain embodiments, each Z is, independently, $CH_3$—, $CH_3CH_2$—, $CH_2OCH_3$—, $CH_2F$— or $HOCH_2$—.

In certain embodiments, at least one Z group is $C_1$-$C_6$ alkyl substituted with one or more $X^x$, wherein each $X^x$ is, independently, $OJ_1$, $NJ_1J_2$, $SJ_1$, $N_3$, $OC(=X)J_1$, $OC(=X)NJ_1J_2$, $NJ_3C(=X)NJ_1J_2$ or CN; wherein each $J_1$, $J_2$ and $J_3$ is, independently, H or $C_1$-$C_6$ alkyl, and X is O, S or $NJ_1$. In another embodiment, at least one Z group is $C_1$-$C_6$ alkyl substituted with one or more $X^x$, wherein each $X^x$ is, independently, halo (e.g., fluoro), hydroxyl, alkoxy (e.g., $CH_3O$—) or azido.

In certain embodiments, each Z group is, independently, $C_1$-$C_6$ alkyl substituted with one or more $X^x$, wherein each $X^x$ is independently $OJ_1$, $NJ_1J_2$, $SJ_1$, $N_3$, $OC(=X)J_1$, $OC(=X)NJ_1J_2$, $NJ_3C(=X)NJ_1J_2$ or CN; wherein each $J_1$, $J_2$ and $J_3$ is, independently, H or $C_1$-$C_6$ alkyl, and X is O, S or $NJ_1$. In another embodiment, each Z group is, independently, $C_1$-$C_6$ alkyl substituted with one or more $X^x$, wherein each $X^x$ is independently halo (e.g., fluoro), hydroxyl, alkoxy (e.g., $CH_3O$—) or azido.

In certain embodiments, at least one Z group is —$CH_2X^x$, wherein $X^x$ is $OJ_1$, $NJ_1J_2$, $SJ_1$, $N_3$, $OC(=X)J_1$, $OC(=X)NJ_1J_2$, $NJ_3C(=X)NJ_1J_2$ or CN; wherein each $J_1$, $J_2$ and $J_3$ is, independently, H or $C_1$-$C_6$ alkyl, and X is O, S or $NJ_1$ In certain embodiments, at least one Z group is —$CH_2X^x$, wherein $X^x$ is halo (e.g., fluoro), hydroxyl, alkoxy (e.g., $CH_3O$—) or azido.

In certain embodiments, each Z group is, independently, —$CH_2X^x$, wherein each $X^x$ is, independently, $OJ_1$, $NJ_1J_2$, $SJ_1$, $N_3$, $OC(=X)J_1$, $OC(=X)NJ_1J_2$, $NJ_3C(=X)NJ_1J_2$ or CN; wherein each $J_1$, $J_2$ and $J_3$ is, independently, H or $C_1$-$C_6$ alkyl, and X is O, S or $NJ_1$. In another embodiment, each Z group is, independently, —$CH_2X^x$, wherein each $X^x$ is, independently, halo (e.g., fluoro), hydroxyl, alkoxy (e.g., $CH_3O$—) or azido.

In certain embodiments, at least one Z is $CH_3$—. In another embodiment, each Z is, $CH_3$—.

In certain embodiments, the Z group of at least one monomer is in the (R)-configuration represented by the formula:

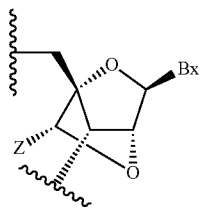

or the formula:

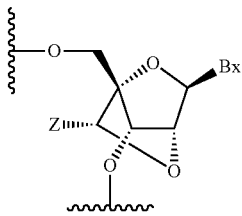

or the formula:

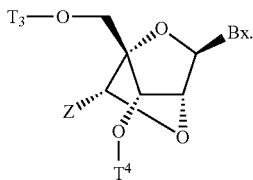

In certain embodiments, the Z group of each monomer of the formula is in the (R)-configuration.

In certain embodiments, the Z group of at least one monomer is in the (S)-configuration represented by the formula:

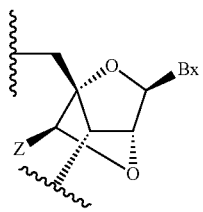

or the formula:

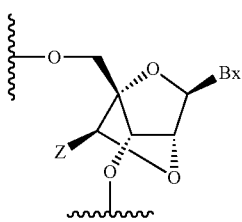

or the formula:

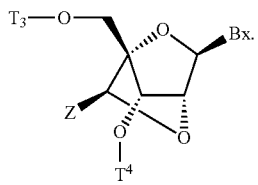

In certain embodiments, the Z group of each monomer of the formula is in the (S)— configuration.

In certain embodiments, $T_3$ is H or a hydroxyl protecting group. In certain embodiments, $T_4$ is H or a hydroxyl protecting group. In a further embodiment $T_3$ is an internucleoside linking group attached to a nucleoside, a nucleotide or a monomeric subunit. In certain embodiments, $T_4$ is an internucleoside linking group attached to a nucleoside, a nucleotide or a monomeric subunit. In certain embodiments, $T_3$ is an internucleoside linking group attached to an oligonucleotide or an oligonucleotide. In certain embodiments, $T_4$ is an internucleoside linking group attached to an oligonucleotide or an oligonucleotide. In certain embodiments, $T_3$ is an internucleoside linking group attached to an oligomeric compound. In certain embodiments, $T_4$ is an internucleoside linking group attached to an oligomeric compound. In certain embodiments, at least one of $T_3$ and $T_4$ comprises an internucleoside linking group selected from phosphodiester or phosphorothioate.

In certain embodiments, oligomeric compounds have at least one region of at least two contiguous monomers of the formula:

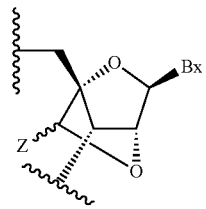

or of the formula:

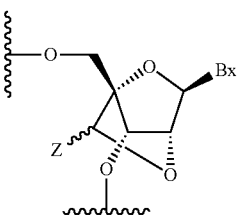

or of the formula:
to

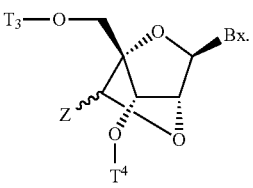

In certain embodiments, the oligomeric compound comprises at least two regions of at least two contiguous monomers of the above formula. In certain embodiments, the oligomeric compound comprises a gapped oligomeric compound. In certain embodiments, the oligomeric compound comprises at least one region of from about 8 to about 14 contiguous β-D-2'-deoxyribofuranosyl nucleosides. In certain embodiments, the oligomeric compound comprises at least one region of from about 9 to about 12 contiguous β-D-2'-deoxyribofuranosyl nucleosides.

In certain embodiments, monmers include sugar mimetics. In certain such embodiments, a mimetic is used in place of the sugar or sugar-internucleoside linkage combination, and the nucleobase is maintained for hybridization to a selected target. Representative examples of a sugar mimetics include, but are not limited to, cyclohexenyl or morpholino. Representative examples of a mimetic for a sugar-internucleoside linkage combination include, but are not limited to, peptide nucleic acids (PNA) and morpholino groups linked by uncharged achiral linkages. In some instances a mimetic is used in place of the nucleobase. Representative nucleobase mimetics are well known in the art and include, but are not limited to, tricyclic phenoxazine analogs and universal bases (Berger et al., Nuc Acid Res. 2000, 28:2911-14, incorporated herein by reference). Methods of synthesis of sugar, nucleoside and nucleobase mimetics are well known to those skilled in the art.

3. Monomeric Linkages

Described herein are linking groups that link monomers (including, but not limited to, modified and unmodified nucleosides and nucleotides) together, thereby forming an oligomeric compound. The two main classes of linking groups are defined by the presence or absence of a phosphorus atom. Representative phosphorus containing linkages include, but are not limited to, phosphodiesters (P=O), phosphotriesters, methylphosphonates, phosphoramidate, and phosphorothioates (P=S). Representative non-phosphorus containing linking groups include, but are not limited to, methylenemethylimino ($-CH_2-N(CH_3)-O-CH_2-$), thiodiester ($-O-C(O)-S-$), thionocarbamate ($-O-C(O)(NH)-S-$); siloxane ($-O-Si(H)_2-O-$); and N,N'-dimethylhydrazine ($-CH_2-N(CH_3)-N(CH_3)-$). Oligomeric compounds having non-phosphorus linking groups are referred to as oligonucleosides. Modified linkages, compared to natural phosphodiester linkages, can be used to alter, typically increase, nuclease resistance of the oligomeric compound. In certain embodiments, linkages having a chiral atom can be prepared a racemic mixtures, as separate enantiomers. Representative chiral linkages include, but are not limited to, alkylphosphonates and phosphorothioates. Methods of preparation of phosphorous-containing and non-phosphorous-containing linkages are well known to those skilled in the art.

The oligomeric compounds described herein contain one or more asymmetric centers and thus give rise to enantiomers, diastereomers, and other stereoisomeric configurations that may be defined, in terms of absolute stereochemistry, as (R) or (S), α or β such as for sugar anomers, or as (D) or (L) such as for amino acids et al. Included in the antisense compounds provided herein are all such possible isomers, as well as their racemic and optically pure forms.

4. Oligomeric Compounds

In certain embodiments, provided herein are oligomeric compounds having reactive phosphorus groups useful for forming linkages including for example phosphodiester and phosphorothioate internucleoside linkages. Methods of preparation and/or purification of precursors or oligomeric compounds are not a limitation of the compositions or methods provided herein. Methods for synthesis and purification of oligomeric compounds including DNA, RNA, oligonucleotides, oligonucleosides, and antisense compounds are well known to those skilled in the art.

Generally, oligomeric compounds comprise a plurality of monomeric subunits linked together by linking groups. Non-limiting examples of oligomeric compounds include primers, probes, antisense compounds, antisense oligonucleotides, external guide sequence (EGS) oligonucleotides, alternate splicers, and siRNAs. As such, these compounds can be introduced in the form of single-stranded, double-stranded, circular, branched or hairpins and can contain structural elements such as internal or terminal bulges or loops. Oligomeric double-stranded compounds can be two strands hybridized to form double-stranded compounds or a single strand with sufficient self complementarity to allow for hybridization and formation of a fully or partially double-stranded compound.

In certain embodiments, the present invention provides chimeric oligomeric compounds. In certain such embodiments, chimeric oligomeric compounds are chimeric oligonucleotides. In certain such embodiments, the chimeric oligonucleotides comprise differently modified nucleotides. In certain embodiments, chimeric oligonucleotides are mixed-backbone antisense oligonucleotides.

In general a chimeric oligomeric compound will have modified nucleosides that can be in isolated positions or grouped together in regions that will define a particular motif. Any combination of modifications and/or mimetic groups can comprise a chimeric oligomeric compound as described herein.

In certain embodiments, chimeric oligomeric compounds typically comprise at least one region modified so as to confer increased resistance to nuclease degradation, increased cellular uptake, and/or increased binding affinity for the target nucleic acid. In certain embodiments, an additional region of the oligomeric compound may serve as a substrate for enzymes capable of cleaving RNA:DNA or RNA:RNA hybrids. By way of example, RNase H is a cellular endonuclease that cleaves the RNA strand of an RNA:DNA duplex. Activation of RNase H, therefore, results in cleavage of the RNA target, thereby greatly enhancing the efficiency of inhibition of gene expression. Consequently, comparable results can often be obtained with shorter oligomeric compounds when chimeras are used, compared to for example phosphorothioate deoxyoligonucleotides hybridizing to the same target region. Cleavage of the RNA target can be routinely detected by gel electrophoresis and, if necessary, associated nucleic acid hybridization techniques known in the art.

In certain embodiments, chimeric oligomeric compounds are gapmers. In certain embodiments, chimeric compounds are short antisense compounds. In certain embodiments, short antisense compounds are gapmers. In certain such embodiments, a mixed-backbone antisense oligomer has one type of internucleotide linkages in one or both wings and a different type of internucleotide linkages in the gap. In certain such embodiments, the mixed-backbone antisense oligonucleotide has phosphodiester linkages in the wings and phosphorothioate linkages in the gap. In certain embodiments in which the internucleotide linkages in a wing is different from the internucleotide linkages in the gap, the internucleotide linkage bridging that wing and the gap is the same as the internucleotide linkage in the wing. In certain embodiments in which the internucleotide linkages in a wing is different from the internucleotide linkages in the gap, the internucleotide linkage bridging that wing and the gap is the same as the internucleotide linkage in the gap.

C. CERTAIN SHORT ANTISENSE COMPOUNDS

Disclosed herein are short antisense compounds 8 to 16, preferably 9 to 15, more preferably 9 to 14, more preferably 10 to 14 nucleotides in length. In certain embodiments, short antisense compounds are 9 to 14 nucleotides in length. In certain embodiments, short antisense compounds are 10 to 14 nucleotides in length. In certain embodiments, such short antisense compounds are short antisense oligonucleotides.

In certain embodiments, short antisense compounds comprise one or more chemical modifications. In certain such embodiments, short antisense compounds comprise at least one modified nucleotide. In certain embodiments short antisense compounds comprise at least two or more modified nucleotides. In certain embodiments, short antisense compounds comprise at least one modified internucleotide linkage. In certain embodiments, short antisense compounds are mixed-backbone oligonucleotides. In certain embodiments, short antisense compounds are chimeric oligonucleotides. In certain embodiments, short antisense oligonucleotides are uniformly modified. In certain embodiments, short antisense oligonucleotides comprise modifications independently selected at each nucleobase and at each linkage.

In certain embodiments, short antisense compounds are short gapmers. In certain such embodiments, short gapmers comprise at least one high affinity modification in one or more wings of the compound. In certain embodiments, short antisense compounds comprise 1 to 3 high-affinity modifications in each wing. In certain embodiments, high affinity modifications of the short antisense compounds allow for a target affinity similar to, or even greater than, the target affinity of longer antisense compounds. In certain embodiments, the high-affinity modified nucleotides are sugar modified nucleotides. Such sugar modified nucleotides include those comprising a bridge between the 4' and 2' position of the sugar. Exemplary high affinity sugar modifications include, but are not limited to, BNA s and other 2'-modifications such as 2'-MOE. In an alternate embodiment of the invention, the high affinity modification is not a 2'-O—$(CH_2)_n$H (n=1-6) sugar-modified nucleotide. In an additional alternate embodiment, the high affinity modified nucleotide is not a 2'-$OCH_3$ or a 2'-$OCH_2CH_2OCH_3$ nucleotide. In certain embodiments, the high-affinity modified nucleotides confer a $\Delta T_m$ of at least 1, at least 1.5, at least 2, at least 2.5, at least 3.0, at least 3.5 or at least 4.0 degrees per nucleotide. Some high-affinity nucleotide modifications are known in the art to increase toxicity. As shown herein, short antisense compounds having a limited number (generally 2 to 6) of high affinity modifications exhibit little to no increase in toxicity but retain or increase affinity for the target RNA, while also significantly reducing expression of the RNA target. Short antisense compounds of the invention may optionally comprise a conjugate group, such as, for example, cholesterol or $C_{1-6}$.

1. Certain Wings

In certain embodiments, the short antisense compounds comprise a 5' wing and/or a 3' wing. In such embodiments, the features of the 3' wing and the features of the 5' wing are selected independently. Thus, in such embodiments, the number of monomers in the 5' wing and the number of monomers (length) in the 3' wing may be the same or may be different; the modifications, if any, in the 5' wing may be the same as the modifications, if any, in the 3' wing or such modifications, if any, may be different; and the monomeric linkages in the 5' wing and the monomeric linkages in the 3' wing may be the same or they may be different.

In certain embodiments a wing comprises one, two or three monomers (i.e. has a length of 1, 2, or 3). In certain embodiments, the monomers of a wing are modified. In certain such embodiments, the monomers of the wing are modified to increase affinity of the antisense compound for its target nucleic acid. In certain embodiments, the monomers of a wing are nucleosides or nucleotides. In certain such embodiments, the nucleosides or nucleotides of the wing comprise a 2' modification. In certain such embodiments, the monomers (nucleosides or nucleotides) of the wing are BNA's. In certain such embodiments, the monomers of the wing are selected from α-L-Methyleneoxy (4'-$CH_2$—O-2') BNA, β-D-Methyleneoxy (4'-$CH_2$—O-2') BNA, Ethyleneoxy (4'-$(CH_2)_2$—O-2') BNA, Aminooxy (4'-$CH_2$—O—N(R)-2') BNA and Oxyamino (4'-$CH_2$—N(R)—O-2') BNA. In certain embodiments, the monomers of a wing comprise a substituent at the 2' position selected from allyl, amino, azido, thio, O-allyl, O—$C_1$-$C_{10}$ alkyl, —$OCF_3$, O—$(CH_2)_2$—O—$CH_3$, 2'-O$(CH_2)_2SCH_3$, O—$(CH_2)_2$—O—$N(R_m)(R_n)$, and O—$CH_2$—C(=O)—$N(R_m)(R_n)$, where each $R_m$ and $R_n$ is, independently, H or substituted or unsubstituted $C_1$-$C_{10}$ alkyl. In certain embodiments, the monomers of a wing are 2'MOE nucleotides.

In certain embodiments, the monomeric linkages in a wing are naturally occurring internucleotide linkages. In certain embodiments, the monomeric linkages in a wing are non-naturally occurring internucleotide or internucleoside linkages. In certain such embodiments, the monomeric linkages in the wing are more resistant to one or more nucleases than naturally occurring internucleotide linkages. In certain such embodiments, the monomeric linkages in the wing are phosphorothioate linkages (P=S). In certain embodiments where a wing has more than one monomeric linkage, the monomeric linkages are the same as one another. In certain embodiments where a wing has more than one monomers linkage, the monomers linkages are different from each other.

One of ordinary skill in the art will recognize that the features and modifications discussed above may be used in any combination to prepare a wing. The table below provides non-limiting examples showing how one might prepare a wing by selecting a certain number of monomers, monomeric modifications (if any), and monomeric linkages both within the wing.

| Length | Monomer type/ modifications | monomeric linkages within wing |
|---|---|---|
| 1 | 2' MOE | None |
| 1 | BNA | None |
| 1 | Methyleneoxy BNA | None |
| 1 | ENA | None |
| 2 | 2' MOE | P=S |
| 2 | BNA | P=S |
| 2 | Methyleneoxy BNA | P=S |
| 2 | ENA | P=S |
| 2 | 2' MOE | P=O |
| 2 | BNA | P=O |
| 2 | Methyleneoxy BNA | P=O |
| 2 | ENA | P=O |
| 3 | 2' MOE | P=S |
| 3 | BNA | P=S |
| 3 | Methyleneoxy BNA | P=S |
| 3 | ENA | P=S |
| 3 | 2' MOE | P=O |
| 3 | BNA | P=O |

| Length | Monomer type/ modifications | monomeric linkages within wing |
|---|---|---|
| 3 | Methyleneoxy BNA | P=O |
| 3 | ENA | P=O |

In certain embodiments in which a wing comprises two, three or four monomers, those two, three or four monomers all comprise the same modifications, if any. In certain embodiments in which a wing comprises two, three or four monomers, one or more of those two, three or four nucleobases comprises one or more modifications that is different from one or more of the modifications of one or more of the remaining monomers.

2. Certain Gaps

In certain embodiments, the short antisense compounds comprise a gap between the 5' wing and the 3' wing. In certain embodiments the gap comprises five, six, seven, eight, nine, ten, eleven, twelve, thirteen, or fourteen monomers. In certain embodiments, the monomers of the gap are unmodified deoxyribonucleotides. In certain embodiments, the monomers of the gap are unmodified ribonucleotides. In certain embodiments, gap modifications (if any) gap result in an antisense compound that, when bound to its target nucleic acid, supports cleavage by an RNase, including, but not limited to, RNase H.

In certain embodiments, the monomeric linkages in the gap are naturally occurring internucleotide linkages. In certain embodiments, the monomeric linkages in the gap are non-naturally occurring linkages. In certain such embodiments, the monomeric linkages in the gap are more resistant to one or more nuclease than naturally occurring internucleotide linkages. In certain such embodiments, the monomeric linkages in the gap are phosphorothioate linkages (P=S). In certain embodiments, the monomeric linkages in the gap are all the same as one another. In certain embodiments, the monomeric linkages within the gap are not all the same.

One of ordinary skill in the art will recognize that the features and modifications discussed above may be used in any combination to prepare a gap. The table below provides non-limiting examples showing how one might prepare a gap by selecting a certain number of monomers, monomeric modifications (if any), and monomeric linkages within the gap region.

| Length | Monomer type/ modifications | Monomeric linkages within gap |
|---|---|---|
| 5 | DNA | P=S |
| 6 | DNA | P=S |
| 7 | DNA | P=S |
| 8 | DNA | P=S |
| 9 | DNA | P=S |
| 10 | DNA | P=S |
| 11 | DNA | P=S |
| 12 | DNA | P=S |
| 13 | DNA | P=S |
| 14 | DNA | P=S |
| 6 | DNA | P=O |
| 7 | DNA | P=O |
| 8 | DNA | P=O |
| 9 | DNA | P=O |
| 10 | DNA | P=O |
| 11 | DNA | P=O |
| 12 | DNA | P=O |
| 8 | RNA | P=S |
| 9 | RNA | P=S |
| 10 | RNA | P=S |
| 11 | RNA | P=S |
| 12 | RNA | P=S |

3. Certain Gapped Antisense Oligomeric Compounds

One of ordinary skill in the art will recognize that the wings and the gaps discussed above may be selected and then combined in a variety of combinations to generate gapped oligomeric compounds, including, but not limited to, gapped antisense oligomeric compounds, and gapped antisense oligonucleotides. The features (length, modifications, linkages) of the 5' wing and the 3' wing may be selected independently of one another. The features of the gap include at least one difference in modification compared to the features of the 5' wing and at least one difference compared to the features of the 3' wing (i.e., there must be at least one difference in modification between neighboring regions to distinguish those neighboring regions from one another). The features of the gap may otherwise be selected independently.

In certain embodiments, the monomeric linkages within a wing and the monomeric linkages within the gap are the same. In certain embodiments, the monomeric linkages within a wing and the monomeric linkages within the gap are different. In certain such embodiments, the monomeric linkage bridging the wing and the gap are the same as the monomeric linkages in the wing. In certain embodiments, the monomeric linkage bridging the wing and the gap are the same as the monomeric linkages in the gap. In certain embodiments, short antisense compounds have uniform linkages throughout the compound. In certain such embodiments, all of the linkages are phosphorothioate (P=S) linkages.

One of ordinary skill in the art will recognize that the 3' wings, 5' wings, gaps, and linkages discussed above may be used in any combination to prepare a gapmer. The table below provides non-limiting examples showing how one might prepare a gapmer by selecting a certain 5' wing, a gap, a 3' wing and certain linkages bridging the gap and each wing.

| 5' Wing | | 5' Bridge | | Gap | | 3' Bridge | | 3' Wing | |
|---|---|---|---|---|---|---|---|---|---|
| Length | Monomer | Link | Link | Length | Monomer | Link | Link | Length | Monomer | Link |
| 2 | MOE | P=S | P=S | 6 | DNA | P=S | P=S | 2 | MOE | P=S |
| 2 | BNA | P=S | P=O | 8 | DNA | P=O | P=S | 3 | BNA | P=S |
| 1 | MOE | None | P=S | 10 | DNA | P=S | P=S | 1 | MOE | P=S |
| 2 | MOE | P=S | P=S | 8 | RNA | P=S | P=S | 2 | MOE | P=S |
| 3 | Methyleneoxy BNA | P=S | P=S | 8 | RNA | P=S | P=S | 3 | MOE | P=S |

-continued

| 5' Wing | | 5' Bridge | | Gap | | 3' Bridge | | 3' Wing | |
|---|---|---|---|---|---|---|---|---|---|
| Length | Monomer | Link | Link | Length | Monomer | Link | Link | Length | Monomer | Link |
| 3 | DNA | P=O | P=O | 10 | RNA | P=S | P=O | 3 | 2'OH | P=O |
| 2 | 2-F | P=S | P=S | 5 | RNA | P=S | P=S | 2 | 2'-F | P=S |
| 1 | MOE | P=O | P=S | 5 | DNA | P=O | P=S | 4 | MOE | P=S |

In certain embodiments, the oligomeric compounds disclosed herein may comprise from about 8 to about 16, preferably 9 to 15, more preferably 9 to 14, more preferably 10 to 14 monomers (i.e. from about 8 to about 16 linked monomers). One of ordinary skill in the art will appreciate that this comprehends antisense compounds of 8, 9, 10, 11, 12, 13, 14, 15 or 16 nucleobases. In certain embodiments, oligomeric compounds are antisense compounds.

In certain embodiments, short antisense compounds are 8 nucleobases in length.

In certain embodiments, short antisense compounds are 9 nucleobases in length.

In certain embodiments, short antisense compounds are 10 nucleobases in length.

In certain embodiments, short antisense compounds are 11 nucleobases in length.

In certain embodiments, short antisense compounds are 12 nucleobases in length.

In certain embodiments, short antisense compounds are 13 nucleobases in length.

In certain embodiments, short antisense compounds are 14 nucleobases in length.

In certain embodiments, short antisense compounds are 15 nucleobases in length.

In certain embodiments, short antisense compounds are 16 nucleobases in length.

In certain embodiments, short antisense compounds are 8 monomers in length. In certain embodiments, short antisense compounds are 9 monomers in length. In certain embodiments, short antisense compounds are 10 monomers in length. In certain embodiments, short antisense compounds are 11 monomers in length. In certain embodiments, short antisense compounds are monomers in length. In certain embodiments, short antisense compounds are 13 monomers in length. In certain embodiments, short antisense compounds are 14 monomers in length. In certain embodiments, short antisense compounds are 15 monomers in length. In certain embodiments, short antisense compounds are 16 monomers in length. In certain embodiments, short antisense compounds comprise 9 to 15 monomers. In certain embodiments, short antisense compounds comprise 10 to 15 monomers. In certain embodiments, short antisense compounds comprise 12 to 14 monomers. In certain embodiments, short antisense compounds comprise 12 to 14 nucleotides or nucleosides.

One having skill in the art and informed by the short antisense compounds illustrated herein will be able, without undue experimentation, to identify further short antisense compounds.

In certain embodiments, short antisense compounds comprise a gap flanked by more than one wing on either or both sides. Thus, in certain embodiments, a short antisense compound comprises two or more 5' wings and two or more 3' wings. In certain embodiments, a short antisense compound comprises one 5' wing and two or more 3' wings. In certain embodiments, a short antisense compound comprises one 3' wing and two or more 5' wings. Certain such embodiments comprise, for example, the following regions: a first 5' wing—a bridge—a second 5' wing—a bridge—a gap—a bridge—a second 3' wing—a bridge—a first 3'wing. In such embodiments, each region has at least one difference in modification when compared to its neighboring region. Thus, in such embodiments, the second 5' wing and the second 3' wing each independently comprises one or more differences in modification compared to the gap and compared to the first 5' wing and the first 3' wing. In such embodiments, the modifications of the first 3' wing and first 5' wing may either or both be the same or different from the modifications of the gap, if any.

4. Certain Conjugate Groups

In one aspect, oligomeric compounds are modified by covalent attachment of one or more conjugate groups. In general, conjugate groups modify one or more properties of the attached oligomeric compound including but not limited to pharmacodynamic, pharmacokinetic, binding, absorption, cellular distribution, cellular uptake, charge and clearance. Conjugate groups are routinely used in the chemical arts and are linked directly or via an optional linking moiety or linking group to a parent compound such as an oligomeric compound. A preferred list of conjugate groups includes without limitation, intercalators, reporter molecules, polyamines, polyamides, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins and dyes.

Preferred conjugate groups amenable to the present invention include lipid moieties such as a cholesterol moiety (Letsinger et al., Proc. Natl. Acad. Sci. USA, 1989, 86, 6553); cholic acid (Manoharan et al., Bioorg. Med. Chem. Lett., 1994, 4, 1053); a thioether, e.g., hexyl-5-tritylthiol (Manoharan et al., Ann. N.Y. Acad. Sci., 1992, 660, 306; Manoharan et al., Bioorg. Med. Chem. Let., 1993, 3, 2765); a thiocholesterol (Oberhauser et al., Nucl. Acids Res, 1992, 20, 533); an aliphatic chain, e.g., dodecandiol or undecyl residues (Saison-Behmoaras et al., EMBO J., 1991, 10, 111; Kabanov et al., FEBS Lett., 1990, 259, 327; Svinarchuk et al., Biochimie, 1993, 75, 49); a phospholipid, e.g., di-hexadecyl-rac-glycerol or triethyl-ammonium-1,2-di-O-hexadecyl-rac-glycero-3-H-phosphonate (Manoharan et al., Tetrahedron Lett., 1995, 36, 3651; Shea et al., Nucl. Acids Res., 1990, 18, 3777); a polyamine or a polyethylene glycol chain (Manoharan et al., Nucleosides & Nucleotides, 1995, 14, 969); adamantane acetic acid (Manoharan et al., Tetrahedron Lett., 1995, 36, 3651); a palmityl moiety (Mishra et al., Biochim. Biophys. Acta, 1995, 1264, 229); or an octadecylamine or hexylamino-carbonyl-oxycholesterol moiety (Crooke et al., J. Pharmacol. Exp. Ther., 1996, 277, 923).

Linking groups or bifunctional linking moieties such as those known in the art are amenable to the compounds provided herein. Linking groups are useful for attachment of chemical functional groups, conjugate groups, reporter groups and other groups to selective sites in a parent compound such as for example an oligomeric compound. In general a bifunctional linking moiety comprises a hydrocarbyl moiety having two functional groups. One of the functional groups is selected to bind to a parent molecule or compound of interest and the other is selected to bind essentially any selected group such as chemical functional group or a conjugate group. In some embodiments, the linker comprises a chain structure or an oligomer of repeating units such as ethylene glycol or amino acid units. Examples of functional groups that are routinely used in a bifunctional linking moiety include, but are not limited to, electrophiles for reacting with nucleophilic groups and nucleophiles for reacting with electrophilic groups. In some embodiments, bifunctional linking moieties include amino, hydroxyl, carboxylic acid, thiol, unsaturations (e.g., double or triple bonds), and the like. Some nonlimiting examples of bifunctional linking moieties include 8-amino-3,6-dioxaoctanoic acid (ADO), succinimidyl 4-(N-maleimidomethyl)cyclohexane-1-carboxylate (SMCC) and 6-aminohexanoic acid (AHEX or AHA). Other linking groups include, but are not limited to, substituted $C_1$-$C_{10}$ alkyl, substituted or unsubstituted $C_2$-$C_{10}$ alkenyl or substituted or unsubstituted $C_2$-$C_{10}$ alkynyl, wherein a non-limiting list of preferred substituent groups includes hydroxyl, amino, alkoxy, carboxy, benzyl, phenyl, nitro, thiol, thioalkoxy, halogen, alkyl, aryl, alkenyl and alkynyl.

5. Synthesis Purification and Analysis

Oligomerization of modified and unmodified nucleosides and nucleotides can be routinely performed according to literature procedures for DNA (Protocols for Oligonucleotides and Analogs, Ed. Agrawal (1993), Humana Press) and/or RNA (Scaringe, Methods (2001), 23, 206-217. Gait et al., Applications of Chemically synthesized RNA in RNA: Protein Interactions, Ed. Smith (1998), 1-36. Gallo et al., Tetrahedron (2001), 57, 5707-5713).

Oligomeric compounds provided herein can be conveniently and routinely made through the well-known technique of solid phase synthesis. Equipment for such synthesis is sold by several vendors including, for example, Applied Biosystems (Foster City, Calif.). Any other means for such synthesis known in the art may additionally or alternatively be employed. It is well known to use similar techniques to prepare oligonucleotides such as the phosphorothioates and alkylated derivatives. The invention is not limited by the method of antisense compound synthesis.

Methods of purification and analysis of oligomeric compounds are known to those skilled in the art. Analysis methods include capillary electrophoresis (CE) and electrospray-mass spectroscopy. Such synthesis and analysis methods can be performed in multi-well plates. The method of the invention is not limited by the method of oligomer purification.

D. ANTISENSE

Antisense mechanisms are all those involving the hybridization of a compound with target nucleic acid, wherein the outcome or effect of the hybridization is either target degradation or target occupancy with concomitant stalling of the cellular machinery involving, for example, transcription or splicing.

One type of antisense mechanism involving target degradation includes an RNase H. RNase H is a cellular endonuclease which cleaves the RNA strand of an RNA:DNA duplex. It is known in the art that single-stranded antisense compounds which are "DNA-like" elicit RNase H activity in mammalian cells. Activation of RNase H, therefore, results in cleavage of the RNA target, thereby greatly enhancing the efficiency of DNA-like oligonucleotide-mediated inhibition of gene expression.

In certain embodiments, chemically-modified antisense compounds have a higher affinity for target RNAs than does non-modified DNA. In certain such embodiments, that higher affinity in turn provides increased potency allowing for the administration of lower doses of such compounds, reduced potential for toxicity and improvement in therapeutic index and decreased overall cost of therapy.

The present disclosure demonstrates that the incorporation of chemically-modified high-affinity nucleotides and nucleosides into antisense compounds allows for the design of short antisense compounds 8-16 nucleobases in length useful for the reduction of target RNAs and/or target proteins in cells, tissues, and animals, including, but not limited to, humans with increased potency and improved therapeutic index. Thus, in certain embodiments, provided herein are short antisense compounds comprising high-affinity nucleotide modifications useful for reducing a target RNA in vivo. Certain such short antisense compounds are effective at lower doses than previously described antisense compounds, allowing for a reduction in toxicity and cost of treatment. In addition, certain short antisense compounds have greater potential for oral dosing.

To address the need for more potent antisense compounds, provided herein are short antisense compounds (8-16, preferably 9 to 15, more preferably 9 to 14, more preferably 10 to 14 nucleotides in length) with increased activity in vivo relative to longer compounds. Certain short antisense compounds are gapmer compounds comprising high-affinity chemically-modified nucleotides on the 3' and 5' ends (wings) of the compound. In certain embodiments, the addition of high-affinity modified nucleotides allows antisense compounds to be active against, and specific for, their intended target RNA in vivo despite being shorter in length. Contemplated herein are short antisense compounds wherein each of the wings independently comprises 1 to 3 high-affinity modified nucleotides. In certain embodiments, the high-affinity modifications are sugar modifications. High-affinity modified nucleotides include, but are not limited to, BNA s or other 2'-modified nucleotides, such as 2'-MOE nucleotides. Also contemplated are short antisense compounds having at least one modified internucleotide linkage, such as a phosphorothioate internucleotide linkage. In certain embodiments, the short antisense compounds of the present invention can have all phosphorothioate internucleoside linkages. The short antisense compounds optionally comprise a conjugate group. As shown herein, short antisense compounds have greater affinity for target RNA than they have for DNA and are significantly more potent in vivo as shown by reduction of target mRNA as well as by amelioration of a variety of disease indications.

As used herein, an RNA which is involved in regulating glucose metabolism or clearance, lipid metabolism, cholesterol metabolism or insulin metabolism is any RNA involved in the biochemical pathways that regulate these processes. Such RNAs are well known in the art. Examples of target genes include, but are not limited to, ApoB-100 (also known as APOB; Ag(x) antigen; apoB-48; apolipoprotein B; apolipoprotein B-100; apolipoprotein B48) and GCGR (also known as glucagon receptor; GR), CRP, DGAT2, GCCR, PCSK9, PTEN, PTP1B, SGLT2, and SOD1.

1. Modulation of Target Expression

In certain embodiments, a target is identified and antisense oligonucleotides are designed to modulate that target or its expression. In certain embodiments, designing an oligomeric compound to a target nucleic acid molecule can be a multistep process. Typically the process begins with the identification of a target protein, the activity of which is to be modulated, and then identifying the nucleic acid the expression of which yields the target protein. In certain embodiments, designing of an antisense compound results in an antisense compound that is hybridizable to the targeted nucleic acid molecule. In certain embodiments, the antisense compound is an antisense oligonucleotide or antisense oligonucleoside. In certain embodiments, an antisense compound and a target nucleic acid are complementary to one another. In certain such embodiments, an antisense compound is perfectly complementary to a target nucleic acid. In certain embodiments, an antisense compound includes one mismatch. In certain embodiments, an antisense compound includes two mismatches. In certain embodiments, an antisense compound includes three or more mismatches.

Modulation of expression of a target nucleic acid can be achieved through alteration of any number of nucleic acid functions. In certain embodiments, the functions of RNA to be modulated include, but are not limited to, translocation functions, which include, but are not limited to, translocation of the RNA to a site of protein translation, translocation of the RNA to sites within the cell which are distant from the site of RNA synthesis, and translation of protein from the RNA. RNA processing functions that can be modulated include, but are not limited to, splicing of the RNA to yield one or more RNA species, capping of the RNA, 3' maturation of the RNA and catalytic activity or complex formation involving the RNA which may be engaged in or facilitated by the RNA. Modulation of expression can result in the increased level of one or more nucleic acid species or the decreased level of one or more nucleic acid species, either temporally or by net steady state level. Thus, in one embodiment modulation of expression can mean increase or decrease in target RNA or protein levels. In another embodiment modulation of expression can mean an increase or decrease of one or more RNA splice products, or a change in the ratio of two or more splice products.

In certain embodiments, expression of a target gene is modulated using an oligomeric compound comprising from about 8 to about 16, preferably 9 to 15, more preferably 9 to 14, more preferably 10 to 14 monomers (i.e. from about 8 to about 16 linked monomers). One of ordinary skill in the art will appreciate that this comprehends methods of modulating expression of a target gene using one or more antisense compounds of 8, 9, 10, 11, 12, 13, 14, 15 or 16 nucleobases.

In certain embodiments, methods of modulating a target gene comprises use of a short antisense compound that is 8 nucleobases in length. In certain embodiments, methods of modulating a target gene comprises use of a short antisense compound that is 9 nucleobases in length. In certain embodiments, methods of modulating a target gene comprises use of a short antisense compound that is 8 nucleobases in length. In certain embodiments, methods of modulating a target gene comprises use of a short antisense compound that is 10 nucleobases in length. In certain embodiments, methods of modulating a target gene comprises use of a short antisense compound that is 10 nucleobases in length. In certain embodiments, methods of modulating a target gene comprises use of a short antisense compound that is 11 nucleobases in length. In certain embodiments, methods of modulating a target gene comprises use of a short antisense compound that is 12 nucleobases in length. In certain embodiments, methods of modulating a target gene comprises use of a short antisense compound that is 13 nucleobases in length. In certain embodiments, methods of modulating a target gene comprises use of a short antisense compound that is 14 nucleobases in length. In certain embodiments, methods of modulating a target gene comprises use of a short antisense compound that is 15 nucleobases in length. In certain embodiments, methods of modulating a target gene comprises use of a short antisense compound that is 16 nucleobases in length.

In certain embodiments, methods of modulating expression of a target gene comprises use of a short antisense compound comprising 9 to 15 monomers. In certain embodiments, methods of modulating expression of a target gene comprises use of a short antisense compound comprising 10 to 15 monomers. In certain embodiments, methods of modulating expression of a target gene comprises use of a short antisense compound comprising 12 to 14 monomers. In certain embodiments, methods of modulating expression of a target gene comprises use of a short antisense compound comprising 12 or 14 nucleotides or nucleosides.

2. Hybridization

In certain embodiments, antisense compounds specifically hybridize when there is a sufficient degree of complementarity to avoid non-specific binding of the antisense compound to non-target nucleic acid sequences under conditions in which specific binding is desired, i.e., under physiological conditions in the case of in vivo assays or therapeutic treatment, and under conditions in which assays are performed in the case of in vitro assays.

As used herein, "stringent hybridization conditions" or "stringent conditions" refers to conditions under which an antisense compound will hybridize to its target sequence, but to a minimal number of other sequences. Stringent conditions are sequence-dependent and will be different in different circumstances, and "stringent conditions" under which antisense compounds hybridize to a target sequence are determined by the nature and composition of the antisense compounds and the assays in which they are being investigated.

3. Complementarity

It is understood in the art that incorporation of nucleotide affinity modifications may allow for a greater number of mismatches compared to an unmodified compound. Similarly, certain oligonucleotide sequences may be more tolerant to mismatches than other oligonucleotide sequences. One of ordinary skill in the art is capable of determining an appropriate number of mismatches between oligonucleotides, or between an oligonucleotide and a target nucleic acid, such as by determining melting temperature ($T_m$). $T_m$ or $\Delta T_m$ can be calculated by techniques that are familiar to one of ordinary skill in the art. For example, techniques described in Freier et al. (*Nucleic Acids Research*, 1997, 25, 22: 4429-4443) allow one of ordinary skill in the art to evaluate nucleotide modifications for their ability to increase the melting temperature of an RNA:DNA duplex.

4. Identity

Antisense compounds, or a portion thereof, may have a defined percent identity to a SEQ ID NO, or a compound having a specific Isis number. As used herein, a sequence is identical to the sequence disclosed herein if it has the same nucleobase pairing ability. For example, an RNA which contains uracil in place of thymidine in the disclosed sequences of the compounds described herein would be considered identical as they both pair with adenine. This identity may be over the entire length of the oligomeric compound, or in a portion of the antisense compound (e.g., nucleobases 1-20 of a 27-mer may be compared to a 20-mer to determine percent identity of the oligomeric compound to the SEQ ID NO. It is understood by those skilled in the art that an antisense compound need not have an identical sequence to those described herein to function similarly to the antisense compound described herein. Shortened versions of antisense compounds taught herein, or non-identical versions of the antisense compounds taught herein, are also provided herein. Non-identical versions are those wherein each base does not have the same pairing activity as the antisense compounds disclosed herein. Bases do not have the same pairing activity by being shorter or having at least one abasic site. Alternatively, a non-identical version can include at least one base replaced with a different base with different pairing activity (e.g., G can be replaced by C, A, or T). Percent identity is calculated according to the number of bases that have identical base pairing corresponding to the SEQ ID NO or antisense compound to which it is being compared. The non-identical bases may be adjacent to each other, dispersed through out the oligonucleotide, or both.

For example, a 16-mer having the same sequence as nucleobases 2-17 of a 20-mer is 80% identical to the 20-mer. Alternatively, a 20-mer containing four nucleobases not identical to the 20-mer is also 80% identical to the 20-mer. A 14-mer having the same sequence as nucleobases 1-14 of an 18-mer is 78% identical to the 18-mer. Such calculations are well within the ability of those skilled in the art.

The percent identity is based on the percent of nucleobases in the original sequence present in a portion of the modified sequence. Therefore, a 30 nucleobase antisense compound comprising the full sequence of the complement of a 20 nucleobase active target segment would have a portion of 100% identity with the complement of the 20 nucleobase active target segment, while further comprising an additional 10 nucleobase portion. In the context of the instant description, the complement of an active target segment may constitute a single portion. In preferred embodiments, the oligonucleotides provided herein are at least 80%, at least 85%, at least 90%, at least 95%, at least 96%, at least 97%, at least 98%, at least 99% or 100% identical to at least a portion of the complement of the active target segments presented herein.

E. TARGET NUCLEIC ACIDS, REGIONS AND SEGMENTS

In certain embodiments, short antisense compounds may be designed to target any target nucleic acid. In certain embodiments, the target nucleic acid encodes a target that is clinically relevant. In such embodiments, modulation of the target nucleic acid results in clinical benefit. Certain target nucleic acids include, but are not limited to, the target nucleic acids illustrated in Table 1.

In certain embodiments, a target nucleic acid is a nucleic acid molecule encoding ApoB. Nucleic acid molecules that encode ApoB include, without limitation, SEQ ID NO: 1 and SEQ ID NO: 2.

In certain embodiments, a target nucleic acid is a nucleic acid molecule encoding SGLT2. Nucleic acid molecules that encode SGLT2 include, without limitation, SEQ ID NO: 3.

In certain embodiments, a target nucleic acid is a nucleic acid molecule encoding PCSK9. Nucleic acid molecules that encode PCSK9 include, without limitation, SEQ ID NO: 4.

In certain embodiments, a target nucleic acid is a nucleic acid molecule encoding SOD1. Nucleic acid molecules that encode SOD1 include, without limitation, SEQ ID NO: 5.

In certain embodiments, a target nucleic acid is a nucleic acid molecule encoding CRP. Nucleic acid molecules that encode CRP include, without limitation, SEQ ID NO: 6.

In certain embodiments, a target nucleic acid is a nucleic acid molecule encoding GCCR. Nucleic acid molecules that encode GCCR include, without limitation, SEQ ID NO: 7 and SEQ ID NO: 8.

In certain embodiments, a target nucleic acid is a nucleic acid molecule encoding GCGR. Nucleic acid molecules that encode GCGR include, without limitation, SEQ ID NO: 9.

In certain embodiments, a target nucleic acid is a nucleic acid molecule encoding DGAT2. Nucleic acid molecules that encode DGAT2 include, without limitation, SEQ ID NO: 10.

In certain embodiments, a target nucleic acid is a nucleic acid molecule encoding PTP1B. Nucleic acid molecules that encode PTP1B include, without limitation, SEQ ID NO: 11 and SEQ ID NO: 12.

In certain embodiments, a target nucleic acid is a nucleic acid molecule encoding PTEN. Nucleic acid molecules that encode PTEN include, without limitation, SEQ ID NO: 14 or SEQ ID NO: 15.

TABLE 1

Certain Target Nucleic Acids

| Target | Species | GENBANK® Accession Number | SEQ ID NO |
|---|---|---|---|
| ApoB | Human | NM_000384.1 | 1 |
| ApoB | Mouse | XM_137955.5 | 2 |
| SGLT2 | Human | NM_003041.1 | 3 |
| PCSK9 | Human | NM_174936.2 | 4 |
| SOD1 | Human | X02317.1 | 5 |
| CRP | Human | NM_000567.1 | 6 |
| GCCR | Mouse | BC031885.1 | 7 |
| GCCR | Human | Nucleotides 1 to 10600 of AC012634 | 8 |
| GCGR | Human | NM_000160.1 | 9 |
| DGAT2 | Human | NM_032564.2 | 10 |
| PTP1B | Human | NM_002827.2 | 11 |
| PTP1B | Human | Nucleotides 1417800 to 1425600 of NT_011362.9 | 12 |
| PTEN | Mouse | U92437.1 | 13 |
| PTEN | Human | NM_000314.4 | 14 |
| PTEN | Human | Nucleotides 8063255 to 8167140 of NT_033890.3 | 15 |

The targeting process usually includes determination of at least one target region, segment, or site within the target nucleic acid for the antisense interaction to occur such that the desired effect will result.

In certain embodiments, the 5'-most nucleotide of a target region is the 5' target site of a short antisense compound and the 3'-most nucleotide of a target region is the 3' target site of the same short antisense compound. In certain embodiments, the 5'-most nucleotide of a target region is the 5' target site of a short antisense compound and the 3'-most nucleotide of a target region is the 3' target site of a different short antisense compound. In certain embodiments, a target region comprises a nucleotide sequence within 10, 15, or 20 nucleotides of a 5' target site or a 3' target site.

In certain embodiments, a target region is a structurally defined region of the nucleic acid. For example, in certain such embodiments, a target region may encompass a 3' UTR, a 5' UTR, an exon, an intron, a coding region, a translation initiation region, translation termination region, or other defined nucleic acid region.

The locations on the target nucleic acid defined by having one or more active short antisense compounds targeted thereto are referred to as "active target segments." In certain embodiments, the target nucleic acid having one or more active short antisense compounds targeted thereto is a target RNA. When an active target segment is defined by multiple short antisense compounds, the compounds are preferably separated by no more than about 10 nucleotides on the target sequence, more preferably no more than about 5 nucleotides on the target sequence, even more preferably the short antisense compounds are contiguous, most preferably the short antisense compounds are overlapping. There may be substantial variation in activity (e.g., as defined by percent inhibition) of the short antisense compounds within an active target segment. Active short antisense compounds are those that modulate the expression of their target nucleic acid, including but not limited to a target RNA. Active short antisense compounds inhibit expression of their target RNA at least 10%, preferably 20%. In a preferred embodiment, at least about 50%, preferably about 70% of the short antisense compounds targeted to the active target segment modulate expression of their target RNA at least 40%. In a more preferred embodiment, the level of inhibition required to define an active short antisense compound is defined based on the results from the screen used to define the active target segments.

A suitable target segment is at least about an 8-nucleobase portion of a target region to which an active short antisense compound is targeted. Target segments can include DNA or RNA sequences that comprise at least the 8 consecutive nucleobases from the 5'-terminus of one of the illustrative target segments (the remaining nucleobases being a consecutive stretch of the same DNA or RNA beginning immediately upstream of the 5'-terminus of the target segment and continuing until the DNA or RNA comprises about 8 to about 16 nucleobases). Target segments are also represented by DNA or RNA sequences that comprise at least the 8 consecutive nucleobases from the 3'-terminus of one of the illustrative target segments (the remaining nucleobases being a consecutive stretch of the same DNA or RNA beginning immediately downstream of the 3'-terminus of the target segment and continuing until the DNA or RNA comprises about 8 to about 16 nucleobases). It is also understood that antisense target segments may be represented by DNA or RNA sequences that comprise at least 8 consecutive nucleobases from an internal portion of the sequence of an illustrative target segment, and may extend in either or both directions until the short antisense compound comprises about 8 to about 16 nucleobases. One having skill in the art armed with the target segments illustrated herein will be able, without undue experimentation, to identify further target segments.

Once one or more target regions, segments or sites have been identified, short antisense compounds are chosen which are sufficiently complementary to the target, i.e., hybridize sufficiently well and with sufficient specificity, to give the desired effect.

The short antisense compounds may also be targeted to regions of the target nucleobase sequence comprising any consecutive nucleobases 8 to 16 nucleobases in length along the target nucleic acid molecule.

Target segments 8-16 nucleobases in length comprising a stretch of at least eight (8) consecutive nucleobases selected from within the illustrative target segments are considered to be suitable for targeting as well. Thus, the short antisense compounds may also encompass 8-16 nucleobases within those segments identified herein as beginning at a particular 5' target site. Any segment of 8, 9, 10, 11, or more preferably 12, 13, 14, 15 or 16 contiguous nucleobases in a 50, preferably 25, more preferably 16 nucleobase perimeter around these regions are also considered to be suitable for targeting.

In a further embodiment, the "suitable target segments" identified herein may be employed in a screen for additional short antisense compounds that modulate the expression of a target nucleic acid. "Modulators" are those compounds that decrease or increase the expression of a target nucleic acid and which comprise at least an 8-nucleobase portion which is complementary to a target segment. The screening method comprises the steps of contacting a target segment of a nucleic acid with one or more candidate modulators, and selecting for one or more candidate modulators which decrease or increase the expression of a target nucleic acid. Once it is shown that the candidate modulator or modulators are capable of modulating (e.g. either decreasing or increasing) the expression of a target nucleic acid, the modulator may then be employed in further investigative studies of the function of the target, or for use as a research, diagnostic, or therapeutic agent in accordance with the present invention.

For all short antisense compounds discussed herein, sequence, monomer, monomeric modification, and monomeric linkage may each be selected independently. In certain embodiments, short antisense compounds are described by a motif. In such embodiments, any motif may be used with any sequence, whether or not the sequence and/or the motif is specifically disclosed herein. In certain embodiments, short antisense compounds comprise modifications that are not amenable to description by motif (for example, short antisense compounds comprising several different modifications and/or linkages at various positions throughout the compound). Such combinations may be incorporated for any sequence, whether or not it is disclosed herein. The sequence listing accompanying this filing provides certain nucleic acid sequences independent of chemical modification. Though that listing identifies each sequence as either "RNA" or "DNA" as required, in reality, those sequences may be modified with any combination of chemical modifications and/or motifs.

In certain embodiments, short antisense compounds comprise at least one high-affinity modified monomer. In certain embodiments, provided are short antisense compounds targeted to nucleic acid molecules encoding targets including, but not limited to, ApoB-100 (also known as APOB; Ag(x) antigen; apoB48; apolipoprotein B; apolipoprotein B-100; apolipoprotein B48), GCGR (also known as glucagon receptor; GR), CRP, DGAT2, GCCR, PCSK9, PTEN, PTP1B, SGLT2, and SOD1. In certain such embodiments, such short antisense compounds are targeted to a nucleic acid molecule encoding any of those targets.

F. CERTAIN TARGETS

In certain embodiments, short antisense compounds may be designed to modulate any target. In certain embodiments, the target is clinically relevant. In such embodiments, modulation of the target results in clinical benefit. Certain targets are preferentially expressed in the kidney. Certain targets are preferentially expressed in the liver. Certain targets are associated with a metabolic disorder. Certain targets are associated to a cardiovascular disorder. In certain embodiments, a target is selected from: ApoB, SGLT2, PCSK9, SOD1, CRP, GCCR, GCGR, DGAT2, PTP1B, and PTEN. In certain embodiments, a target is selected from: ApoB, SGLT2, PCSK9, SOD1, CRP, GCCR, GCGR, DGAT2, and PTP1B. In certain embodiments, a target is any protein other than SGLT2.

In certain embodiments, short antisense compounds exhibit liver and kidney-specific target RNA reduction in vivo. Such property renders those short antisense compounds particularly useful for inhibition of many target RNAs involved in metabolic and cardiovascular diseases. Thus, provided herein are methods of treating cardiovascular or metabolic disorders by contacting said kidney or liver tissues with short antisense compounds targeted to RNAs associated with said disorders. Thus, also provided are methods for ameliorating any of a variety of metabolic or cardiovascular disease indications with the short antisense compounds of the present invention.

1. ApoB

ApoB (also known as apolipoprotein B-100; ApoB-100, apolipoprotein B-48; ApoB-48 and Ag(x) antigen), is a large glycoprotein that serves an indispensable role in the assembly and secretion of lipids and in the transport and receptor-mediated uptake and delivery of distinct classes of lipoproteins. ApoB performs a variety of activities, from the absorption and processing of dietary lipids to the regulation of circulating lipoprotein levels (Davidson and Shelness, *Annu. Rev. Nutr.*, 2000, 20, 169-193). This latter property underlies its relevance in terms of atherosclerosis susceptibility, which is highly correlated with the ambient concentration of ApoB-containing lipoproteins (Davidson and Shelness, Annu. Rev. Nutr., 2000, 20, 169-193). ApoB-100 is the major protein component of LDL-C and contains the domain required for interaction of this lipoprotein species with the LDL receptor. Elevated levels of LDL-C are a risk factor for cardiovascular disease, including atherosclerosis.

Definitions

"ApoB" is the gene product or protein of which expression is to be modulated by administration of a short antisense compound.

"ApoB nucleic acid" means any nucleic acid encoding ApoB. For example, in certain embodiments, a ApoB nucleic acid includes, without limitation, a DNA sequence encoding ApoB, an RNA sequence transcribed from DNA encoding ApoB, and an mRNA sequence encoding ApoB.

"ApoB mRNA" means an mRNA encoding ApoB.

ApoB Therapeutic Indications

In certain embodiments, the invention provides methods of modulating the expression of ApoB in an individual comprising administering a short antisense compound targeted to an ApoB nucleic acid. In certain embodiments, the invention provides methods of treating an individual comprising administering one or more pharmaceutical compositions comprising a short antisense compound targeted to an ApoB nucleic acid. In certain embodiments, the individual has hypercholesterolemia, non-familial hypercholesterolemia, familial hypercholesterolemia, heterozygous familial hypercholesterolemia, homozygous familial hypercholesterolemia, mixed dyslipidemia, atherosclerosis, a risk of developing atherosclerosis, coronary heart disease, a history of coronary heart disease, early onset coronary heart disease, one or more risk factors for coronary heart disease, type II diabetes, type II diabetes with dyslipidemia, dyslipidemia, hypertriglyceridemia, hyperlipidemia, hyperfattyacidemia, hepatic steatosis, non-alcoholic steatohepatitis, or non-alcoholic fatty liver disease.

Guidelines for lipid-lowering therapy were established in 2001 by Adult Treatment Panel III (ATP III) of the National Cholesterol Education Program (NCEP), and updated in 2004 (Grundy et al., Circulation, 2004, 110, 227-239). The guidelines include obtaining a complete lipoprotein profile, typically after a 9 to 12 hour fast, for determination of LDL-C, total cholesterol, and HDL-C levels. According to the most recently established guidelines, LDL-C levels of 130-159 mg/dL, 160-189 mg/dL, and greater than or equal to 190 mg/dL are considered borderline high, high, and very high, respectively. Total cholesterol levels of 200-239 and greater than or equal to 240 mg/dL are considered borderline high and high, respectively. HDL-C levels of less than 40 mg/dL are considered low.

In certain embodiments, the individual has been identified as in need of lipid-lowering therapy. In certain such embodiments, the individual has been identified as in need of lipid-lowering therapy according to the guidelines established in 2001 by Adult Treatment Panel III (ATP III) of the National Cholesterol Education Program (NCEP), and updated in 2004 (Grundy et al., Circulation, 2004, 110, 227-239). In certain such embodiments, the individual in need of lipid-lowering therapy has LDL-C above 190 mg/dL. In certain such embodiments, the individual in need of lipid-lowering therapy has LDL-C above 160 mg/dL. In certain such embodiments, the individual in need of lipid-lowering therapy has LDL-C above 130 mg/dL. In certain such embodiments the individual in need of lipid-lowering therapy has LDL-C above 100 mg/dL. In certain such embodiments the individual in need of lipid-lowering therapy should maintain LDL-C below 160 mg/dL. In certain such embodiments the individual in need of lipid-lowering therapy should maintain LDL-C below 130 mg/dL. In certain such embodiments the individual in need of lipid-lowering therapy should maintain LDL-C below 100 mg/dL. In certain such embodiments the individual should maintain LDL-C below 70 mg/dL.

In certain embodiments the invention provides methods for reducing ApoB in an individual. In certain embodiments the invention provides methods for reducing ApoB-containing lipoprotein in an individual. In certain embodiments the invention provides methods for reducing LDL-C in an individual. In certain embodiments the invention provides methods for reducing VLDL-C in an individual. In certain embodiments the invention provides methods for reducing IDL-C in an individual. In certain embodiments the invention provides methods for reducing non-HDL-C in an individual. In certain embodiments the invention provides methods for reducing Lp(a) in an individual. In certain embodiments the invention provides methods for reducing serum triglyceride in an individual. In certain embodiments the invention provides methods for reducing liver triglyceride in an individual. In certain embodiments the invention provides methods for reducing Ox-LDL-C in an individual. In certain embodiments the invention provides methods for reducing small LDL particles in an individual. In certain embodiments the invention provides methods for reducing small VLDL particles in an individual. In certain embodiments the invention provides methods for reducing phospholipids in an individual. In certain embodiments the invention provides methods for reducing oxidized phospholipids in an individual.

In certain embodiments the invention provides methods for reducing Ox-LDL-C concentration in a subject. In certain such embodiments, the reduction in ApoB, LDL-C, VLDL-C, IDL-C, total cholesterol, non-HDL-C, Lp(a), triglycerides, or Ox-LDL-C is, independently, selected from at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, and at least 100%. In certain such embodiments, the reduction in ApoB, LDL-C, VLDL-C, IDL-C, total cholesterol, non-HDL-C, Lp(a), triglyerides, or Ox-LDL-C is, independently, selected from at least 20%, at least 30%, at least 40%, at least 50%, at least 60%, and at least 70%. In certain such embodiments, the reduction in ApoB, LDL-C, VLDL-C, IDL-C, total cholesterol, non-HDL-C, Lp(a), triglyerides, or Ox-LDL-C is, independently, selected from at least 40%, at least 50%, at least 60%, and at least 70%.

In certain embodiments, the invention provides method for raising HDL-C concentration in a subject.

In certain embodiments, the methods provided by the present invention do not lower HDL-C. In certain embodiments, the methods provided by the present invention do not result in accumulation of lipids in the liver. In certain embodiments, the methods provided by the present invention do not cause hepatic steatosis.

In certain embodiments, the invention provides methods for lowering ApoB concentration in a subject while reducing side effects associated with treatment. In certain such embodiments, a side effect is liver toxicity. In certain such embodiments, a side effect is abnormal liver function. In certain such embodiments, a side effect is elevated alanine aminotransferase (ALT). In certain such embodiments, a side effect is elevated aspartate aminotransferase (AST).

In certain embodiments, the invention provides methods for lowering ApoB concentration in a subject who is not reaching target LDL-C levels as a result of lipid-lowering therapy. In certain such embodiments, a short antisense compound targeted to an ApoB nucleic acid is the only lipid-lowering agent administered to the subject. In certain such embodiments, the subject has not complied with recommended lipid-lowering therapy. In certain such embodiments, a pharmaceutical composition of the invention is co-administered with an additional different lipid-lowering therapy. In certain such embodiments, an additional lipid-lowering therapy is LDL-apheresis. In certain such embodiments, an additional lipid-lowering therapy is a statin. In certain such embodiments, an additional lipid-lowering therapy is ezetimibe.

In certain embodiments, the invention provides methods for lowering ApoB concentration in a statin-intolerant subject. In certain such embodiments, the subject has creatine kinase concentration increases as a result of statin administration. In certain such embodiments, the subject has liver function abnormalities as a result of statin administration. In certain such embodiments the subject has muscle aches as a result of statin administration. In certain such embodiments the subject has central nervous system side effects as a result of statin administration. In certain embodiments, the subject has not complied with recommended statin administration.

In certain embodiments, the invention provides methods for lowering liver triglycerides in a subject. In certain such embodiments, the subject has elevated liver triglycerides. In certain such embodiments, the subject has steatohepatitis. In certain such embodiments, the subject has steatosis. In certain such embodiments, liver triglyceride levels are measured by magnetic resonance imaging.

In certain embodiments, the invention provides methods for reducing coronary heart disease risk in a subject. In certain embodiments the invention provides methods for slowing the progression of atherosclerosis in a subject. In certain such embodiments the invention provides methods for stopping the progression of atherosclerosis in a subject. In certain such embodiments the invention provides methods for reducing the size and/or prevalence of atherosclerotic plaques in a subject. In certain embodiments the methods provided reduce a subject's risk of developing atherosclerosis.

In certain embodiments the methods provided improve the cardiovascular outcome in a subject. In certain such embodiments improved cardiovascular outcome is the reduction of the risk of developing coronary heart disease. In certain such embodiments, improved cardiovascular outcome is a reduction in the occurrence of one or more major cardiovascular events, which include, but are not limited to, death, myocardial infarction, reinfarction, stroke, cardiogenic shock, pulmonary edema, cardiac arrest, and atrial dysrhythmia. In certain such embodiments, the improved cardiovascular outcome is evidenced by improved carotid intimal media thickness. In certain such embodiments, improved carotid intimal media thickness is a decrease in thickness. In certain such embodiments, improved carotid intimal media thickness is a prevention an increase of intimal media thickness.

In certain embodiments a pharmaceutical composition comprising a short antisense compound targeted to an ApoB nucleic acid is for use in therapy. In certain embodiments, the therapy is the reduction of LDL-C, ApoB, VLDL-C, IDL-C, non-HDL-C, Lp(a), serum triglyceride, liver triglyceride, Ox-LDL-C, small LDL particles, small VLDL, phospholipids, or oxidized phospholipids in an individual. In certain embodiments, the therapy is the treatment of hypercholesterolemia, non-familial hypercholesterolemia, familial hypercholesterolemia, heterozygous familial hypercholesterolemia, homozygous familial hypercholesterolemia, mixed dyslipidemia, atherosclerosis, a risk of developing atherosclerosis, coronary heart disease, a history of coronary heart disease, early onset coronary heart disease, one or more risk factors for coronary heart disease, type II diabetes, type II diabetes with dyslipidemia, dyslipidemia, hypertriglyceridemia, hyperlipidemia, hyperfattyacidemia, hepatic steatosis, non-alcoholic steatohepatitis, or non-alcoholic fatty liver disease. In additional embodiments, the therapy is the reduction of CHD risk. In certain the therapy is prevention of atherosclerosis. In certain embodiments, the therapy is the prevention of coronary heart disease.

In certain embodiments a pharmaceutical composition comprising a short antisense compound targeted to an ApoB nucleic acid is used for the preparation of a medicament for reducing LDL-C, ApoB, VLDL-C, IDL-C, non-HDL-C, Lp(a), serum triglyceride, liver triglyceride, Ox-LDL-C, small LDL particles, small VLDL, phospholipids, or oxidized phospholipids in an individual. In certain embodiments pharmaceutical composition comprising a short antisense compound targeted to an ApoB nucleic acid is used for the preparation of a medicament for reducing coronary heart disease risk. In certain embodiments a short antisense compound targeted to an ApoB nucleic acid is used for the preparation of a medicament for the treatment of hypercholesterolemia, non-familial hypercholesterolemia, familial hypercholesterolemia, heterozygous familial hypercholesterolemia, homozygous familial hypercholesterolemia, mixed dyslipidemia, atherosclerosis, a risk of developing atherosclerosis, coronary heart disease, a history of coronary heart disease, early onset coronary heart disease, one or more risk factors for coronary heart disease, type II diabetes, type II diabetes with dyslipidemia, dyslipidemia, hypertriglyceridemia, hyperlipidemia, hyperfattyacidemia, hepatic steatosis, non-alcoholic steatohepatitis, or non-alcoholic fatty liver disease.

ApoB Combination Therapies

In certain embodiments, one or more pharmaceutical compositions comprising a short antisense compound targeted to an ApoB nucleic acid are co-administered with one or more other pharmaceutical agents. In certain embodiments, such one or more other pharmaceutical agents are designed to treat the same disease or condition as the one or more pharmaceutical compositions of the present invention. In certain such embodiments, the one or more pharmaceutical agents are lipid-lowering agents. In certain embodiments, such one or more other pharmaceutical agents are designed to treat a different disease or condition as the one or more pharmaceutical compositions of the present invention. In certain embodiments, such one or more other pharmaceutical agents are designed to treat an undesired effect of one or more pharmaceutical compositions of the present invention. In certain embodiments, one or more pharmaceutical compositions of the present invention are co-administered with another pharmaceutical agent to treat an undesired effect of that other pharmaceutical agent. In certain embodiments, one or more pharmaceutical compositions of the present invention and one or more other pharmaceutical agents are administered at the same time. In certain embodiments, one or more pharmaceutical compositions of the present invention and one or more other pharmaceutical agents are administered at different times. In certain embodiments, one or more pharmaceutical compositions of the present invention and one or more other pharmaceutical agents are prepared together in a single formulation. In certain embodiments, one or more pharmaceutical compositions of the present invention and one or more other pharmaceutical agents are prepared separately.

In certain embodiments, pharmaceutical agents that may be co-administered with a pharmaceutical composition comprising a short antisense compound targeted to an ApoB nucleic acid include lipid-lowering agents. In certain such embodiments, pharmaceutical agents that may be co-administered with a pharmaceutical composition of the present invention include, but are not limited to atorvastatin, simvastatin, rosuvastatin, and ezetimibe. In certain such embodiments, the lipid-lowering agent is administered prior to administration of a pharmaceutical composition of the present invention. In certain such embodiments, the lipid-lowering agent is administered following administration of a pharmaceutical composition of the present invention. In certain such embodiments the lipid-lowering agent is administered at the same time as a pharmaceutical composition of the present invention. In certain such embodiments the dose of a co-administered lipid-lowering agent is the same as the dose that would be administered if the lipid-lowering agent was administered alone. In certain such embodiments the dose of a co-administered lipid-lowering agent is lower than the dose that would be administered if the lipid-lowering agent was administered alone. In certain such embodiments the dose of a co-administered lipid-lowering agent is greater than the dose that would be administered if the lipid-lowering agent was administered alone.

In certain embodiments, a co-administered lipid-lowering agent is a HMG-CoA reductase inhibitor. In certain such embodiments the HMG-CoA reductase inhibitor is a statin. In certain such embodiments the statin is selected from atorvastatin, simvastatin, pravastatin, fluvastatin, and rosuvastatin.

In certain embodiments, a co-administered lipid-lowering agent is a cholesterol absorption inhibitor. In certain such embodiments, cholesterol absorption inhibitor is ezetimibe.

In certain embodiments, a co-administered lipid-lowering agent is a co-formulated HMG-CoA reductase inhibitor and cholesterol absorption inhibitor. In certain such embodiments the co-formulated lipid-lowering agent is ezetimibe/simvastatin.

In certain embodiments, a co-administered lipid-lowering agent is a microsomal triglyceride transfer protein inhibitor (MTP inhibitor).

In certain embodiments, a co-administered pharmaceutical agent is a bile acid sequestrant. In certain such embodiments, the bile acid sequestrant is selected from cholestyramine, colestipol, and colesevelam.

In certain embodiments, a co-administered pharmaceutical agent is a nicotinic acid. In certain such embodiments, the nicotinic acid is selected from immediate release nicotinic acid, extended release nicotinic acid, and sustained release nicotinic acid.

In certain embodiments, a co-administered pharmaceutical agent is a fibric acid. In certain such embodiments, a fibric acid is selected from gemfibrozil, fenofibrate, clofibrate, bezafibrate, and ciprofibrate.

Further examples of pharmaceutical agents that may be co-administered with a pharmaceutical composition comprising a short antisense compound targeted to an ApoB nucleic acid include, but are not limited to, corticosteroids, including but not limited to prednisone; immunoglobulins, including, but not limited to intravenous immunoglobulin (IVIg); analgesics (e.g., acetaminophen); anti-inflammatory agents, including, but not limited to non-steroidal anti-inflammatory drugs (e.g., ibuprofen, COX-1 inhibitors, and COX-2, inhibitors); salicylates; antibiotics; antivirals; antifungal agents; antidiabetic agents (e.g., biguanides, glucosidase inhibitors, insulins, sulfonylureas, and thiazolidenediones); adrenergic modifiers; diuretics; hormones (e.g., anabolic steroids, androgen, estrogen, calcitonin, progestin, somatostan, and thyroid hormones); immunomodulators; muscle relaxants; antihistamines; osteoporosis agents (e.g., biphosphonates, calcitonin, and estrogens); prostaglandins, antineoplastic agents; psychotherapeutic agents; sedatives; poison oak or poison sumac products; antibodies; and vaccines.

In certain embodiments, a pharmaceutical composition comprising a short antisense compound targeted to an ApoB nucleic acid may be administered in conjunction with a lipid-lowering therapy. In certain such embodiments, a lipid-lowering therapy is therapeutic lifestyle change. In certain such embodiments, a lipid-lowering therapy is LDL apheresis.

In one embodiment, the antisense compounds provided herein can be used to lower the level of apolipoprotein B-containing lipoproteins in a human subject. As used herein, "apolipoprotein B-containing lipoprotein" refers to any lipoprotein that has apolipoprotein B as its protein component, and is understood to include LDL, VLDL, IDL, and lipoprotein(a). LDL, VLDL, IDL and lipoprotein(a) each contain one molecule of apolipoprotein B, thus a serum apolipoprotein B measurement reflects the total number of these lipoproteins. As is known in the art, each of the aforementioned lipoproteins is atherogenic. Thus, lowering one or more apolipoprotein B-containing lipoproteins in serum may provide a therapeutic benefit to a human subject. Small LDL particles are considered to be particularly atherogenic relative to large LDL particles, thus lowering small LDL particles can provide a therapeutic benefit to a human subject. Additional lipid parameters can also be determined in a subject. Reduction of total cholesterol:HDL ratio or LDL:HDL ratio is a clinically desirable improvement in cholesterol ratio. Similarly, it is clinically desirable to reduce serum triglycerides in humans who exhibit elevated lipid levels.

Other indications of cardiovascular disease that can be measured in a subject include serum LDL particle size; serum LDL cholesteryl ester concentration; serum LDL cholesteryl ester composition; the extent of polyunsaturation of serum LDL cholesteryl esters; and serum HDL cholesterol levels. As used herein, "serum LDL particle size" refers to the classification of serum LDL particle size, which may be very small, small, medium, or large, and is typically expressed in g/μmol. In the context of the present invention, "serum LDL cholesteryl ester concentration" means the amount of cholesteryl ester present in LDL particles, and is typically measured as mg/dL. In the context of the present invention, "serum LDL cholesteryl ester composition" is a measurement of the percentage of saturated, monounsaturated and polyunsaturated cholesteryl ester fatty acids present in serum LDL particles. "Polyunsaturation of serum LDL cholesteryl esters" means the percentage of polyunsaturated cholesteryl ester fatty acids in serum LDL particles.

Methods of obtaining serum or plasma samples for analysis and methods of preparation of the serum samples to allow for analysis are well known to those skilled in the art. With regard to measurements of lipoproteins, cholesterol, triglyceride and cholesteryl esters, the terms "serum" and "plasma" are herein used interchangeably.

In another embodiment, the antisense compounds provided herein can be used to treat metabolic disorders. A variety of biomarkers can be used for evaluating metabolic disease. For example, blood glucose levels can be determined by a physician or even by the patient using a commonly available test kit or glucometer (for example, the Ascensia ELITE™ kit, Ascensia (Bayer), Tarrytown N.Y., or Accucheck, Roche Diagnostics). Glycated hemoglobin (HbA$_{1c}$) can also be measured. HbA$_{1c}$ is a stable minor hemoglobin variant formed in vivo via posttranslational modification by glucose, and it contains predominantly glycated NH$_2$-terminal β-chains. There is a strong correlation between levels of HbA$_{1c}$ and the average blood glucose levels over the previous 3 months. Thus HbA$_{1c}$ is often viewed as the "gold standard" for measuring sustained blood glucose control (Bunn, H. F. et al., 1978, Science. 200, 21-7). HbA$_{1c}$ can be measured by ion-exchange HPLC or immunoassay; home blood collection and mailing kits for HbA$_{1c}$ measurement are now widely available. Serum fructosamine is another measure of stable glucose control and can be measured by a colorimetric method (Cobas Integra, Roche Diagnostics).

Certain Short Antisense Compounds Targeted to an ApoB Nucleic Acid

In certain embodiments, short antisense compounds are targeted to an ApoB nucleic acid having the sequence of GENBANK® Accession No. NM_000384.1, incorporated herein as SEQ ID NO: 1. In certain such embodiments, a short antisense compound targeted to SEQ ID NO: 1 is at least 90% complementary to SEQ ID NO: 1. In certain such embodiments, a short antisense compound targeted to SEQ ID NO: 1 is at least 95% complementary to SEQ ID NO: 1. In certain such embodiments, a short antisense compound targeted to SEQ ID NO: 1 is 100% complementary to SEQ ID NO: 1. In certain embodiments, a short antisense compound targeted to SEQ ID NO: 1 comprises a nucleotide sequence selected from the nucleotide sequences set forth in Table 2 and Table 3.

The nucleotide sequence set forth in each SEQ ID NO in Tables 2 and 3 is independent of any modification to a sugar moiety, a monomeric linkage, or a nucleobase. As such, short antisense compounds defined by a SEQ ID NO may comprise, independently, one or more modifications to a sugar moiety, an internucleoside linkage, or a nucleobase. Antisense compounds described by Isis Number (Isis NO.) indicate a combination of nucleobase sequence and one or more modifications to a sugar moiety, an internucleoside linkage, or a nucleobase.

Tables 2 and 3 illustrate examples of short antisense compounds targeted to SEQ ID NO: 1. Table 2 illustrates short antisense compounds that are 100% complementary to SEQ ID NO: 1. Table 3 illustrates short antisense compounds that have one or two mismatches with respect to SEQ ID NO: 1. The column labeled 'gapmer motif' indicates the wing-gap-wing motif of each short antisense compounds. The gap segment comprises 2'-deoxynucleotides and each nucleotide of each wing segment comprises a 2'-modified sugar. The particular 2'-modified sugar is also indicated in the 'gapmer motif' column. For example, '2-10-2 MOE' means a 2-10-2 gapmer motif, where a gap segment of ten 2'-deoxynucleotides is flanked by wing segments of two nucleotides, where the nucleotides of the wing segments are 2'-MOE nucleotides. Internucleoside linkages are phosphorothioate. The short antisense compounds comprise 5-methylcytidine in place of unmodified cytosine, unless "unmodified cytosine" is listed in the gapmer motif column, in which case the indicated cytosines are unmodified cytosines. For example, "5-mC in gap only" indicates that the gap segment has 5-methylcytosines, while the wing segments have unmodified cytosines.

TABLE 2

Short Antisense Compounds targeted to SEQ ID NO: 1

| ISIS No | 5' Target Site | 3' Target Site | Sequence (5'-3') | Gapmer Motif | SEQ ID NO |
|---|---|---|---|---|---|
| 372816 | 263 | 278 | CCGGAGGTGCTTGAAT | 3-10-3 MOE | 16 |
| 372894 | 264 | 277 | CGGAGGTGCTTGAA | 2-10-2 MOE | 17 |
| 372817 | 428 | 443 | GAAGCCATACACCTCT | 3-10-3 MOE | 18 |
| 372895 | 429 | 442 | AAGCCATACACCTC | 2-10-2 MOE | 19 |
| 372818 | 431 | 446 | GTTGAAGCCATACACC | 3-10-3 MOE | 20 |
| 372896 | 432 | 445 | TTGAAGCCATACAC | 2-10-2 MOE | 21 |
| 372819 | 438 | 453 | CCTCAGGGTTGAAGCC | 3-10-3 MOE | 22 |
| 372897 | 439 | 452 | CTCAGGGTTGAAGC | 2-10-2 MOE | 23 |
| 372820 | 443 | 458 | TTTGCCCTCAGGGTTG | 3-10-3 MOE | 24 |
| 372898 | 444 | 457 | TTGCCCTCAGGGTT | 2-10-2 MOE | 25 |
| 372821 | 468 | 483 | AGTTCTTGGTTTTCTT | 3-10-3 MOE | 26 |
| 372899 | 469 | 482 | GTTCTTGGTTTTCT | 2-10-2 MOE | 27 |
| 372822 | 587 | 602 | CCTCTTGATGTTCAGG | 3-10-3 MOE | 28 |
| 372900 | 588 | 601 | CTCTTGATGTTCAG | 2-10-2 MOE | 29 |
| 372823 | 592 | 607 | ATGCCCTCTTGATGT | 3-10-3 MOE | 30 |
| 372901 | 593 | 606 | TGCCCCTCTTGATG | 2-10-2 MOE | 31 |

TABLE 2-continued

Short Antisense Compounds targeted to SEQ ID NO: 1

| ISIS No | 5' Target Site | 3' Target Site | Sequence (5'-3') | Gapmer Motif | SEQ ID NO |
|---|---|---|---|---|---|
| 346583 | 715 | 728 | TGCCACATTGCCCT | 3-8-3 MOE | 32 |
| 346584 | 716 | 729 | TTGCCACATTGCCC | 3-8-3 MOE | 33 |
| 346585 | 717 | 730 | GTTGCCACATTGCC | 3-8-3 MOE | 34 |
| 346586 | 718 | 731 | TGTTGCCACATTGC | 3-8-3 MOE | 35 |
| 346587 | 719 | 732 | CTGTTGCCACATTG | 3-8-3 MOE | 36 |
| 346588 | 720 | 733 | TCTGTTGCCACATT | 3-8-3 MOE | 37 |
| 346589 | 721 | 734 | TTCTGTTGCCACAT | 3-8-3 MOE | 38 |
| 346590 | 722 | 735 | TTTCTGTTGCCACA | 3-8-3 MOE | 39 |
| 346591 | 723 | 736 | ATTTCTGTTGCCAC | 3-8-3 MOE | 40 |
| 372824 | 929 | 944 | GTAGGAGAAAGGCAGG | 3-10-3 MOE | 41 |
| 372902 | 930 | 943 | TAGGAGAAAGGCAG | 2-10-2 MOE | 42 |
| 372825 | 1256 | 1271 | GGCTTGTAAAGTGATG | 3-10-3 MOE | 43 |
| 372903 | 1257 | 1270 | GCTTGTAAAGTGAT | 2-10-2 MOE | 44 |
| 372826 | 1304 | 1319 | CCACTGGAGGATGTGA | 3-10-3 MOE | 45 |
| 372904 | 1305 | 1318 | CACTGGAGGATGTG | 2-10-2 MOE | 46 |
| 372829 | 2135 | 2150 | TTTCAGCATGCTTTCT | 3-10-3 MOE | 47 |
| 372907 | 2136 | 2149 | TTCAGCATGCTTTC | 2-10-2 MOE | 48 |
| 372832 | 2774 | 2789 | CATATTTGTCACAAAC | 3-10-3 MOE | 49 |
| 372910 | 2775 | 2788 | ATATTTGTCACAAA | 2-10-2 MOE | 50 |
| 372833 | 2779 | 2794 | ATGCCCATATTTGTCA | 3-10-3 MOE | 51 |
| 372911 | 2780 | 2793 | TGCCCATATTTGTC | 2-10-2 MOE | 52 |
| 372835 | 2961 | 2976 | TTTTGGTGGTAGAGAC | 3-10-3 MOE | 53 |
| 372913 | 2962 | 2975 | TTTGGTGGTAGAGA | 2-10-2 MOE | 54 |
| 346592 | 3248 | 3261 | TCTGCTTCGCACCT | 3-8-3 MOE | 55 |
| 346593 | 3249 | 3262 | GTCTGCTTCGCACC | 3-8-3 MOE | 56 |
| 346594 | 3250 | 3263 | AGTCTGCTTCGCAC | 3-8-3 MOE | 57 |
| 346595 | 3251 | 3264 | CAGTCTGCTTCGCA | 3-8-3 MOE | 58 |
| 346596 | 3252 | 3265 | TCAGTCTGCTTCGC | 3-8-3 MOE | 59 |
| 346597 | 3253 | 3266 | CTCAGTCTGCTTCG | 3-8-3 MOE | 60 |
| 346598 | 3254 | 3267 | CCTCAGTCTGCTTC | 3-8-3 MOE | 61 |
| 346599 | 3255 | 3268 | GCCTCAGTCTGCTT | 3-8-3 MOE | 62 |
| 346600 | 3256 | 3269 | AGCCTCAGTCTGCT | 3-8-3 MOE | 63 |
| 372836 | 3350 | 3365 | AACTCTGAGGATTGTT | 3-10-3 MOE | 64 |
| 372914 | 3351 | 3364 | ACTCTGAGGATTGT | 2-10-2 MOE | 65 |
| 372837 | 3355 | 3370 | TCATTAACTCTGAGGA | 3-10-3 MOE | 66 |
| 372915 | 3356 | 3369 | CATTAACTCTGAGG | 2-10-2 MOE | 67 |
| 372838 | 3360 | 3375 | ATTCATCATTAACTCT | 3-10-3 MOE | 68 |

TABLE 2-continued

Short Antisense Compounds targeted to SEQ ID NO: 1

| ISIS No | 5' Target Site | 3' Target Site | Sequence (5'-3') | Gapmer Motif | SEQ ID NO |
|---|---|---|---|---|---|
| 372916 | 3361 | 3374 | TTCATCATTAACTC | 2-10-2 MOE | 69 |
| 372839 | 3409 | 3424 | TTGTTCTGAATGTCCA | 3-10-3 MOE | 70 |
| 387461 | 3409 | 3424 | TTGTTCTGAATGTCCA | 3-10-3 Methyleneoxy BNA Unmodified cytosines in gap | 70 |
| 380147 | 3409 | 3424 | TTGTTCTGAATGTCCA | 3-10-3 Methyleneoxy BNA | 70 |
| 372917 | 3410 | 3423 | TGTTCTGAATGTCC | 2-10-2 MOE | 73 |
| 372840 | 3573 | 3588 | CAGATGAGTCCATTTG | 3-10-3 MOE | 74 |
| 372918 | 3574 | 3587 | AGATGAGTCCATTT | 2-10-2 MOE | 75 |
| 372841 | 3701 | 3716 | ATCCACAGGGAAATTG | 3-10-3 MOE | 76 |
| 372919 | 3702 | 3715 | TCCACAGGGAAATT | 2-10-2 MOE | 77 |
| 372843 | 4219 | 4234 | CAGTTGTACAAGTTGC | 3-10-3 MOE | 78 |
| 372921 | 4220 | 4233 | AGTTGTACAAGTTG | 2-10-2 MOE | 79 |
| 372844 | 4301 | 4316 | CACAGAGTCAGCCTTC | 3-10-3 MOE | 80 |
| 372922 | 4302 | 4315 | ACAGAGTCAGCCTT | 2-10-2 MOE | 81 |
| 372845 | 4308 | 4323 | GGTCAACCACAGAGTC | 3-10-3 MOE | 82 |
| 372923 | 4309 | 4322 | GTCAACCACAGAGT | 2-10-2 MOE | 83 |
| 346601 | 5588 | 5601 | CAGCCACATGCAGC | 3-8-3 MOE | 84 |
| 346602 | 5589 | 5602 | CCAGCCACATGCAG | 3-8-3 MOE | 85 |
| 346603 | 5590 | 5603 | ACCAGCCACATGCA | 3-8-3 MOE | 86 |
| 346604 | 5591 | 5604 | TACCAGCCACATGC | 3-8-3 MOE | 87 |
| 346605 | 5592 | 5605 | TTACCAGCCACATG | 3-8-3 MOE | 88 |
| 346606 | 5593 | 5606 | GTTACCAGCCACAT | 3-8-3 MOE | 89 |
| 346607 | 5594 | 5607 | GGTTACCAGCCACA | 3-8-3 MOE | 90 |
| 346608 | 5595 | 5608 | AGGTTACCAGCCAC | 3-8-3 MOE | 91 |
| 346609 | 5596 | 5609 | TAGGTTACCAGCCA | 3-8-3 MOE | 92 |
| 372851 | 5924 | 5939 | AGGTTCTGCTTTCAAC | 3-10-3 MOE | 93 |
| 372929 | 5925 | 5938 | GGTTCTGCTTTCAA | 2-10-2 MOE | 94 |
| 372854 | 6664 | 6679 | TACTGATCAAATTGTA | 3-10-3 MOE | 95 |
| 372932 | 6665 | 6678 | ACTGATCAAATTGT | 2-10-2 MOE | 96 |
| 372855 | 6908 | 6923 | TTTTTCTTGTATCTGG | 3-10-3 MOE | 97 |
| 372933 | 6909 | 6922 | TTTTCTTGTATCTG | 2-10-2 MOE | 98 |
| 372856 | 7190 | 7205 | ATCCATTAAAACCTGG | 3-10-3 MOE | 99 |
| 372934 | 7191 | 7204 | TCCATTAAAACCTG | 2-10-2 MOE | 100 |
| 372858 | 7817 | 7832 | ATATTGCTCTGCAAAG | 3-10-3 MOE | 101 |
| 372936 | 7818 | 7831 | TATTGCTCTGCAAA | 2-10-2 MOE | 102 |
| 346610 | 7818 | 7831 | TATTGCTCTGCAAA | 3-8-3 MOE | 102 |

TABLE 2-continued

Short Antisense Compounds targeted to SEQ ID NO: 1

| ISIS No | 5' Target Site | 3' Target Site | Sequence (5'-3') | Gapmer Motif | SEQ ID NO |
|---|---|---|---|---|---|
| 346611 | 7819 | 7832 | ATATTGCTCTGCAA | 3-8-3 MOE | 104 |
| 346612 | 7820 | 7833 | AATATTGCTCTGCA | 3-8-3 MOE | 105 |
| 346613 | 7821 | 7834 | GAATATTGCTCTGC | 3-8-3 MOE | 106 |
| 346614 | 7822 | 7835 | AGAATATTGCTCTG | 3-8-3 MOE | 107 |
| 346615 | 7823 | 7836 | TAGAATATTGCTCT | 3-8-3 MOE | 108 |
| 346616 | 7824 | 7837 | ATAGAATATTGCTC | 3-8-3 MOE | 109 |
| 346617 | 7825 | 7838 | GATAGAATATTGCT | 3-8-3 MOE | 110 |
| 346618 | 7826 | 7839 | GGATAGAATATTGC | 3-8-3 MOE | 111 |
| 372859 | 7995 | 8010 | ATGGAATCCTCAAATC | 3-10-3 MOE | 112 |
| 372937 | 7996 | 8009 | TGGAATCCTCAAAT | 2-10-2 MOE | 113 |
| 372861 | 8336 | 8351 | GAATTCTGGTATGTGA | 3-10-3 MOE | 114 |
| 372939 | 8337 | 8350 | AATTCTGGTATGTG | 2-10-2 MOE | 115 |
| 372862 | 8341 | 8356 | AGCTGGAATTCTGGTA | 3-10-3 MOE | 116 |
| 372940 | 8342 | 8355 | GCTGGAATTCTGGT | 2-10-2 MOE | 117 |
| 372863 | 8539 | 8554 | TGAAAATCAAAATTGA | 3-10-3 MOE | 118 |
| 372941 | 8540 | 8553 | GAAAATCAAAATTG | 2-10-2 MOE | 119 |
| 372871 | 9344 | 9359 | AAACAGTGCATAGTTA | 3-10-3 MOE | 120 |
| 372949 | 9345 | 9358 | AACAGTGCATAGTT | 2-10-2 MOE | 121 |
| 372872 | 9515 | 9530 | TTCAGGAATTGTTAAA | 3-10-3 MOE | 122 |
| 372950 | 9516 | 9529 | TCAGGAATTGTTAA | 2-10-2 MOE | 123 |
| 372875 | 9794 | 9809 | TTTTGTTTCATTATAG | 3-10-3 MOE | 124 |
| 372953 | 9795 | 9808 | TTTGTTTCATTATA | 2-10-2 MOE | 125 |
| 372877 | 10157 | 10172 | GATGACACTTGATTTA | 3-10-3 MOE | 126 |
| 372955 | 10158 | 10171 | ATGACACTTGATTT | 2-10-2 MOE | 127 |
| 372878 | 10161 | 10176 | GTGTGATGACACTTGA | 3-10-3 MOE | 128 |
| 372956 | 10162 | 10175 | TGTGATGACACTTG | 2-10-2 MOE | 129 |
| 372879 | 10167 | 10182 | TATTCAGTGTGATGAC | 3-10-3 MOE | 130 |
| 372957 | 10168 | 10181 | ATTCAGTGTGATGA | 2-10-2 MOE | 131 |
| 372880 | 10172 | 10187 | ATTGGTATTCAGTGTG | 3-10-3 MOE | 132 |
| 372958 | 10173 | 10186 | TTGGTATTCAGTGT | 2-10-2 MOE | 133 |
| 346619 | 10838 | 10851 | CCTCTAGCTGTAAG | 3-8-3 MOE | 134 |
| 346620 | 10839 | 10852 | CCCTCTAGCTGTAA | 3-8-3 MOE | 135 |
| 346621 | 10840 | 10853 | GCCCTCTAGCTGTA | 3-8-3 MOE | 136 |
| 346622 | 10841 | 10854 | GGCCCTCTAGCTGT | 3-8-3 MOE | 137 |
| 346623 | 10842 | 10855 | AGGCCCTCTAGCTG | 3-8-3 MOE | 138 |
| 346624 | 10843 | 10856 | GAGGCCCTCTAGCT | 3-8-3 MOE | 139 |
| 346625 | 10844 | 10857 | AGAGGCCCTCTAGC | 3-8-3 MOE | 140 |

TABLE 2-continued

Short Antisense Compounds targeted to SEQ ID NO: 1

| ISIS No | 5' Target Site | 3' Target Site | Sequence (5'-3') | Gapmer Motif | SEQ ID NO |
|---|---|---|---|---|---|
| 346626 | 10845 | 10858 | AAGAGGCCCTCTAG | 3-8-3 MOE | 141 |
| 346627 | 10846 | 10859 | AAAGAGGCCCTCTA | 3-8-3 MOE | 142 |
| 372890 | 13689 | 13704 | GAATGGACAGGTCAAT | 3-10-3 MOE | 143 |
| 372968 | 13690 | 13703 | AATGGACAGGTCAA | 2-10-2 MOE | 144 |
| 372891 | 13694 | 13709 | GTTTTGAATGGACAGG | 3-10-3 MOE | 145 |
| 372969 | 13695 | 13708 | TTTTGAATGGACAG | 2-10-2 MOE | 146 |
| 372892 | 13699 | 13714 | TGGTAGTTTTGAATGG | 3-10-3 MOE | 147 |
| 372970 | 13700 | 13713 | GGTAGTTTTGAATG | 2-10-2 MOE | 148 |
| 346628 | 13907 | 13920 | TCACTGTATGGTTT | 3-8-3 MOE | 149 |
| 346629 | 13908 | 13921 | CTCACTGTATGGTT | 3-8-3 MOE | 150 |
| 346630 | 13909 | 13922 | GCTCACTGTATGGT | 3-8-3 MOE | 151 |
| 346631 | 13910 | 13923 | GGCTCACTGTATGG | 3-8-3 MOE | 152 |
| 346632 | 13911 | 13924 | TGGCTCACTGTATG | 3-8-3 MOE | 153 |
| 346633 | 13912 | 13925 | CTGGCTCACTGTAT | 3-8-3 MOE | 154 |
| 346634 | 13913 | 13926 | GCTGGCTCACTGTA | 3-8-3 MOE | 155 |
| 346635 | 13914 | 13927 | GGCTGGCTCACTGT | 3-8-3 MOE | 156 |
| 346636 | 13915 | 13928 | AGGCTGGCTCACTG | 3-8-3 MOE | 157 |
| 346637 | 13963 | 13976 | CAGGTCCAGTTCAT | 3-8-3 MOE | 158 |
| 346638 | 13964 | 13977 | GCAGGTCCAGTTCA | 3-8-3 MOE | 159 |
| 346639 | 13965 | 13978 | TGCAGGTCCAGTTC | 3-8-3 MOE | 160 |
| 346640 | 13966 | 13979 | GTGCAGGTCCAGTT | 3-8-3 MOE | 161 |
| 346641 | 13967 | 13980 | GGTGCAGGTCCAGT | 3-8-3 MOE | 162 |
| 346642 | 13968 | 13981 | TGGTGCAGGTCCAG | 3-8-3 MOE | 163 |
| 346643 | 13969 | 13982 | TTGGTGCAGGTCCA | 3-8-3 MOE | 164 |
| 346644 | 13970 | 13983 | TTTGGTGCAGGTCC | 3-8-3 MOE | 165 |
| 346645 | 13971 | 13984 | CTTTGGTGCAGGTC | 3-8-3 MOE | 166 |
| 346646 | 14051 | 14064 | TAACTCAGATCCTG | 3-8-3 MOE | 167 |
| 346647 | 14052 | 14065 | ATAACTCAGATCCT | 3-8-3 MOE | 168 |
| 346648 | 14053 | 14066 | AATAACTCAGATCC | 3-8-3 MOE | 169 |
| 346649 | 14054 | 14067 | AAATAACTCAGATC | 3-8-3 MOE | 170 |
| 346650 | 14055 | 14068 | AAAATAACTCAGAT | 3-8-3 MOE | 171 |
| 346651 | 14056 | 14069 | CAAAATAACTCAGA | 3-8-3 MOE | 172 |
| 346652 | 14057 | 14070 | GCAAAATAACTCAG | 3-8-3 MOE | 173 |
| 346653 | 14058 | 14071 | AGCAAAATAACTCA | 3-8-3 MOE | 174 |
| 346654 | 14059 | 14072 | TAGCAAAATAACTC | 3-8-3 MOE | 175 |

TABLE 3

Short antisense compounds targeted to SEQ ID NO: 1 and having 1 or 2 mismatches

| Isis NO. | 5' Target Site | 3' Target Site | Sequence (5'-3') | Gapmer Motif | SEQ ID NO |
|---|---|---|---|---|---|
| 372894 | 771 | 784 | CGGAGGTGCTTGAA | 2-10-2 MOE | 17 |
| 372905 | 1111 | 1124 | CAGGGCCTGGAGAG | 2-10-2 MOE | 176 |
| 346628 | 1493 | 1506 | TCACTGTATGGTTT | 3-8-3 MOE | 149 |
| 372828 | 2006 | 2021 | TCTGAAGTCCATGATC | 3-10-3 MOE | 177 |
| 372906 | 2007 | 2020 | CTGAAGTCCATGAT | 2-10-2 MOE | 178 |
| 372830 | 2382 | 2397 | TGGGCATGATTCCATT | 3-10-3 MOE | 179 |
| 372908 | 2383 | 2396 | GGGCATGATTCCAT | 2-10-2 MOE | 180 |
| 346616 | 3162 | 3175 | ATAGAATATTGCTC | 3-8-3 MOE | 109 |
| 346617 | 3163 | 3176 | GATAGAATATTGCT | 3-8-3 MOE | 110 |
| 372929 | 3513 | 3526 | GGTTCTGCTTTCAA | 2-10-2 MOE | 94 |
| 372946 | 3800 | 3813 | TGGAGCCCACGTGC | 2-10-2 MOE | 181 |
| 372904 | 4040 | 4053 | CACTGGAGGATGTG | 2-10-2 MOE | 46 |
| 372842 | 4084 | 4099 | TTGAAGTTGAGGGCTG | 3-10-3 MOE | 182 |
| 372920 | 4085 | 4098 | TGAAGTTGAGGGCT | 2-10-2 MOE | 183 |
| 346586 | 4778 | 4791 | TGTTGCCACATTGC | 3-8-3 MOE | 35 |
| 372847 | 5030 | 5045 | ACCAGTATTAATTTTG | 3-10-3 MOE | 184 |
| 372925 | 5031 | 5044 | CCAGTATTAATTTT | 2-10-2 MOE | 185 |
| 372848 | 5192 | 5207 | GTGTTCTTTGAAGCGG | 3-10-3 MOE | 186 |
| 372926 | 5193 | 5206 | TGTTCTTTGAAGCG | 2-10-2 MOE | 187 |
| 372953 | 5625 | 5638 | TTTGTTTCATTATA | 2-10-2 MOE | 125 |
| 372935 | 7585 | 7598 | AGTTACTTTGGTGT | 2-10-2 MOE | 188 |
| 372860 | 8255 | 8270 | TGGTACATGGAAGTCT | 3-10-3 MOE | 189 |
| 372938 | 8256 | 8269 | GGTACATGGAAGTC | 2-10-2 MOE | 190 |
| 391260 | 8256 | 8269 | GGTACATGGAAGTC | 2-10-2 MOE | 190 |
| 392068 | 8256 | 8269 | GGTACATGGAAGTC | 2-10-2 MOE | 190 |
| 387462 | 8256 | 8269 | GGTACATGGAAGTC | 2-10-2 Methyleneoxy BNA | 190 |
| 391872 | 8256 | 8269 | GGTACATGGAAGTC | 1-1-10-2 2'-(butylacetomido)-palmitamide Methyleneoxy BNA/Methyleneoxy BNA Unmodified cytosines in gap | 190 |
| 380148 | 8256 | 8269 | GGTACATGGAAGTC | 2-10-2 Methyleneoxy BNA | 190 |
| 391871 | 8256 | 8269 | GGTACATGGAAGTC | 1-1-10-2 2'-(butylacetomido)-palmitamide/MOE/MOE Unmodified cytosines in gap | 190 |

TABLE 3-continued

Short antisense compounds targeted to SEQ ID NO: 1 and having 1 or 2 mismatches

| Isis NO. | 5' Target Site | 3' Target Site | Sequence (5'-3') | Gapmer Motif | SEQ ID NO |
|---|---|---|---|---|---|
| 391755 | 8256 | 8269 | GGTACATGGAAGTC | 2-10-2 ENA mC in wing only | 190 |
| 398296 | 8256 | 8269 | GGTACATGGAAGTC | 2-10-2 (6'S)-6'-methyl-Methyleneoxy BNA Unmodified Cytosines | 190 |
| 372942 | 8455 | 8468 | TCCATGCCATATGT | 2-10-2 MOE | 200 |
| 372865 | 8888 | 8903 | CCCTGAAGAAGTCCAT | 3-10-3 MOE | 201 |
| 372943 | 8889 | 8902 | CCTGAAGAAGTCCA | 2-10-2 MOE | 202 |
| 372866 | 8908 | 8923 | GCCCAGTTCCATGACC | 3-10-3 MOE | 203 |
| 372944 | 8909 | 8922 | CCCAGTTCCATGAC | 2-10-2 MOE | 204 |
| 372867 | 9058 | 9073 | TTGAGGAAGCCAGATT | 3-10-3 MOE | 205 |
| 372945 | 9059 | 9072 | TGAGGAAGCCAGAT | 2-10-2 MOE | 206 |
| 372870 | 9261 | 9276 | TGGATGCAGTAATCTC | 3-10-3 MOE | 207 |
| 372948 | 9262 | 9275 | GGATGCAGTAATCT | 2-10-2 MOE | 208 |
| 372881 | 10185 | 10200 | TATAAAGTCCAGCATT | 3-10-3 MOE | 209 |
| 372959 | 10186 | 10199 | ATAAAGTCCAGCAT | 2-10-2 MOE | 210 |
| 372882 | 10445 | 10460 | AAGTTCCTGCTTGAAG | 3-10-3 MOE | 211 |
| 372960 | 10446 | 10459 | AGTTCCTGCTTGAA | 2-10-2 MOE | 212 |
| 372964 | 11451 | 11464 | AATGGTGAAGTACT | 2-10-2 MOE | 213 |
| 346612 | 13459 | 13472 | AATATTGCTCTGCA | 3-8-3 MOE | 105 |
| 346613 | 13460 | 13473 | GAATATTGCTCTGC | 3-8-3 MOE | 106 |

In certain embodiments, a target region is nucleotides 263-278 of SEQ ID NO: 1. In certain such embodiments, short antisense compounds targeted to nucleotides 263-278 of SEQ ID NO: 1 comprise a nucleotide sequence selected from SEQ ID NO: 16 or 17. In certain such embodiments, a short antisense compound targeted to nucleotides 263-278 of SEQ ID NO: 1 is selected from Isis NO. 372816 or 372894.

In certain embodiments, a target region is nucleotides 428-483 of SEQ ID NO: 1. In certain such embodiments, a short antisense compound targeted to nucleotides 428-483 of SEQ ID NO: 1 comprises a nucleotide sequence selected from SEQ ID NO 18, 19, 20, 21, 22, 23, 24, 25, 26, or 27. In certain such embodiments, a short antisense compound targeted to nucleotides 428-483 of SEQ ID NO: 1 is selected from Isis NO. 372817, 372895, 372818, 372896, 372819, 372897, 372820, 372898, 372821, or 372899.

In certain embodiments, a target region is nucleotides 428-458 of SEQ ID NO: 1. In certain such embodiments, a short antisense compound targeted to nucleotides 428-458 of SEQ ID NO: 1 comprises a nucleotide sequence selected from SEQ ID NO 18, 19, 20, 21, 22, 23, 24, or 25. In certain such embodiments, a short antisense compound targeted to nucleotides 428-458 of SEQ ID NO: 1 is selected from Isis NO. 372817, 372895, 372818, 372896, 372819, 372897, 372820, or 372898.

In certain embodiments, a target region is nucleotides 468-483 of SEQ ID NO: 1. In certain such embodiments, a short antisense compound targeted to nucleotides 468-483 of SEQ ID NO: 1 comprises a nucleotide sequence selected from SEQ ID NO 26 or 27. In certain such embodiments, a short antisense compound targeted to nucleotides 468-483 of SEQ ID NO: 1 is selected from Isis NO. 372821 or 372899.

In certain embodiments, a target region is nucleotides 587-607 of SEQ ID NO: 1. In certain such embodiments, a short antisense compound targeted to nucleotides 587-607 of SEQ ID NO: 1 comprises a nucleotide sequence selected from SEQ ID NO 28, 29, 30, or 31. In certain such embodiments, a short antisense compound targeted to nucleotides 587-607 of SEQ ID NO: 1 is selected from ISIS NO. 372822, 372900, 372823, or 372901.

In certain embodiments, a target region is nucleotides 715-736 of SEQ ID NO: 1. In certain such embodiments, a short antisense compound targeted to nucleotides 715-736 of SEQ ID NO: 1 comprises a nucleotide sequence selected from SEQ ID NO 32, 33, 34, 35, 36, 37, 38, 39, or 40. In certain such embodiments, a short antisense compound targeted to nucleotides 715-736 of SEQ ID NO: 1 is selected from Isis NO. 346583, 346584, 346585, 346586, 346587, 346588, 346589, 346590, or 346591.

In certain embodiments, a target region is nucleotides 929-944 of SEQ ID NO: 1. In certain such embodiments, a short antisense compound targeted to nucleotides 929-944 of SEQ ID NO: 1 comprises a nucleotide sequence selected from SEQ ID NO 41 or 42. In certain such embodiments, a short antisense compound targeted to nucleotides 929-944 of SEQ ID NO: 1 is selected from Isis NO. 372824 or 372902.

In certain embodiments, a target region is nucleotides 1256-1319 of SEQ ID NO: 1. In certain such embodiments, a short antisense compound targeted to nucleotides 1256-1319 of SEQ ID NO: 1 comprises a nucleotide sequence selected from SEQ ID NO 43, 44, 45, or 46. In certain such embodiments, a short antisense compound targeted to nucleotides 1256-1319 of SEQ ID NO: 1 is selected from Isis NO. 372825, 372903, 372826, or 372904.

In certain embodiments, a target region is nucleotides 1256-1271 of SEQ ID NO: 1. In certain such embodiments, a short antisense compound targeted to nucleotides 1256-1271 of SEQ ID NO: 1 comprises a nucleotide sequence selected from SEQ ID NO 43 or 44. In certain such embodiments, a short antisense compound targeted to nucleotides 1256-1271 of SEQ ID NO: 1 is selected from Isis NO. 372825 or 372903.

In certain embodiments, a target region is nucleotides 1304-1319 of SEQ ID NO: 1. In certain such embodiments, a short antisense compound targeted to nucleotides 1304-1319 of SEQ ID NO: 1 comprises a nucleotide sequence selected from SEQ ID NO 45 or 46. In certain such embodiments, a short antisense compound targeted to nucleotides 1304-1319 of SEQ ID NO: 1 is selected from Isis NO. 372826 or 372904.

In certain embodiments, a target region is nucleotides 2135-2150 of SEQ ID NO: 1. In certain such embodiments, a short antisense compound targeted to nucleotides 2135-2150 of SEQ ID NO: 1 comprises a nucleotide sequence selected from SEQ ID NO 47 or 48. In certain such embodiments, a short antisense compound targeted to nucleotides 2135-2150 of SEQ ID NO: 1 is selected from ISIS NO. 372829 or 372907.

In certain embodiments, a target region is nucleotides 2774-2794 of SEQ ID NO: 1. In certain such embodiments, a short antisense compound targeted to nucleotides 2774-2794 of SEQ ID NO: 1 comprises a nucleotide sequence selected from SEQ ID NO 49, 50, 51, or 52. In certain such embodiments, a short antisense compound targeted to nucleotides 2774-2794 of SEQ ID NO: 1 is selected from ISIS NO. 372832, 372910, 372833, or 372911.

In certain embodiments, a target region is nucleotides 2961-2976 of SEQ ID NO: 1. In certain such embodiments, a short antisense compound targeted to nucleotides 2961-2976 of SEQ ID NO: 1 comprises a nucleotide sequence selected from SEQ ID NO 53 or 54. In certain such embodiments, a short antisense compound targeted to nucleotides 2961-2976 of SEQ ID NO: 1 is selected from ISIS NO. 372835 or 372913.

In certain embodiments, a target region is nucleotides 3248-3269 of SEQ ID NO: 1. In certain such embodiments, a short antisense compound targeted to nucleotides 3248-3269 of SEQ ID NO: 1 comprises a nucleotide sequence selected from SEQ ID NO 55, 56, 57, 58, 59, 60, 61, 62, or 63. In certain such embodiments, a short antisense compound targeted to nucleotides 3248-3269 of SEQ ID NO: 1 is selected from ISIS NO. 346592, 346593, 346594, 346595, 346596, 346597, 346598, 346599, or 346600.

In certain embodiments, a target region is nucleotides 3350-3375 of SEQ ID NO: 1. In certain such embodiments, a short antisense compound targeted to nucleotides 3350-3375 of SEQ ID NO: 1 comprises a nucleotide sequence selected from SEQ ID NO 64, 65, 66, 67, 68, or 69. In certain such embodiments, a short antisense compound targeted to nucleotides 3350-3375 of SEQ ID NO: 1 is selected from ISIS NO. 372836, 372914, 372837, 372915, 372838, or 372916.

In certain embodiments, a target region is nucleotides 3409-3424 of SEQ ID NO: 1. In certain such embodiments, a short antisense compound targeted to nucleotides 3409-3424 of SEQ ID NO: 1 comprises a nucleotide sequence selected from SEQ ID NO 70 or 73. In certain such embodiments, a short antisense compound targeted to nucleotides 3409-3424 of SEQ ID NO: 1 is selected from ISIS NO. 372839, 387461, 380147, or 372917.

In certain embodiments, a target region is nucleotides 3573-3588 of SEQ ID NO: 1. In certain such embodiments, a short antisense compound targeted to nucleotides 3573-3588 of SEQ ID NO: 1 comprises a nucleotide sequence selected from SEQ ID NO 74 or 75. In certain such embodiments, a short antisense compound targeted to nucleotides 3573-3588 of SEQ ID NO: 1 is selected from ISIS NO. 372840 or 372918.

In certain embodiments, a target region is nucleotides 3701-3716 of SEQ ID NO: 1. In certain such embodiments, a short antisense compound targeted to nucleotides 3701-3716 of SEQ ID NO: 1 comprises a nucleotide sequence selected from SEQ ID NO 76 or 77. In certain such embodiments, a short antisense compound targeted to nucleotides 3701-3716 of SEQ ID NO: 1 is selected from ISIS NO. 372841 or 372919.

In certain embodiments, a target region is nucleotides 4219-4234 of SEQ ID NO: 1. In certain such embodiments, a short antisense compound targeted to nucleotides 4219-4234 of SEQ ID NO: 1 comprises a nucleotide sequence selected from SEQ ID NO 78 or 79. In certain such embodiments, a short antisense compound targeted to nucleotides 4219-4234 of SEQ ID NO: 1 is selected from ISIS NO. 372843 or 372921.

In certain embodiments, a target region is nucleotides 4301-4323 of SEQ ID NO: 1. In certain such embodiments, a short antisense compound targeted to nucleotides 4301-4323 of SEQ ID NO: 1 comprises a nucleotide sequence selected from SEQ ID NO 80, 81, 82, or 83. In certain embodiments, a short antisense compound targeted to nucleotides 4301-4323 of SEQ ID NO: 1 is selected from ISIS NO. 372844, 372922, 372845, or 372923.

In certain embodiments, a target region is nucleotides 5588-5609 of SEQ ID NO: 1. In certain such embodiments, a short antisense compound targeted to nucleotides 5588-5609 of SEQ ID NO: 1 comprises a nucleotide sequence selected from SEQ ID NO 84, 85, 86, 87, 88, 89, 90, 91, or 92. In certain such embodiments, a short antisense compound targeted to nucleotides 5588-5609 of SEQ ID NO: 1 is selected from ISIS NO. 346601, 346602, 346603, 346604, 346605, 346606, 346607, 346608, or 346609.

In certain embodiments, a target region is nucleotides 5924-5939 of SEQ ID NO: 1. In certain such embodiments, a short antisense compound targeted to nucleotides 5924-5939 of SEQ ID NO: 1 comprises a nucleotide sequence selected from SEQ ID NO 93 or 94. In certain such embodiments, a short antisense compound targeted to nucleotides 5924-5939 of SEQ ID NO: 1 is selected from ISIS NO. 372851 or 372929.

In certain embodiments, a target region is nucleotides 6664-6679 of SEQ ID NO: 1. In certain such embodiments, a short antisense compound targeted to nucleotides 6664-6679 of SEQ ID NO: 1 comprises a nucleotide sequence selected from SEQ ID NO 95 or 96. In certain such embodiments, a short antisense compound targeted to nucleotides 6664-6679 of SEQ ID NO: 1 is selected from ISIS NO. 372854 or 372932.

In certain embodiments, a target region is nucleotides 6908-6923 of SEQ ID NO: 1. In certain such embodiments, a short antisense compound targeted to nucleotides 6908-6923 of SEQ ID NO: 1 comprises a nucleotide sequence selected from SEQ ID NO 97 or 98. In certain such embodiments, a short antisense compound targeted to nucleotides 6908-6923 of SEQ ID NO: 1 is selected from ISIS NO. 372855 or 372933.

In certain embodiments, a target region is nucleotides 7190-7205 of SEQ ID NO: 1. In certain such embodiments, a short antisense compound targeted to nucleotides 7190-7205 of SEQ ID NO: 1 comprises a nucleotide sequence selected from SEQ ID NO 99 or 100. In certain such embodiments, a short antisense compound targeted to nucleotides 7190-7205 of SEQ ID NO: 1 is selected from ISIS NO. 372856 or 372934.

In certain embodiments, a target region is nucleotides 7817-7839 of SEQ ID NO: 1. In certain such embodiments, a short antisense compound targeted to nucleotides 7817-7839 of SEQ ID NO: 1 comprises a nucleotide sequence selected from SEQ ID NO 101, 102, 104, 105, 106, 107, 108, 109, 110, or 111. In certain such embodiments, a short antisense compound targeted to nucleotides 7817-7839 of SEQ ID NO: 1 is selected from ISIS NO. 372858, 372936, 346610, 346611, 346612, 346613, 346614, 346615, 346616, 346617, or 346618.

In certain embodiments, a target region is nucleotides 7995-8010 of SEQ ID NO: 1. In certain such embodiments, a short antisense compound targeted to nucleotides 7995-8010 of SEQ ID NO: 1 comprises a nucleotide sequence selected from SEQ ID NO 112 or 113. In certain such embodiments, a short antisense compound targeted to nucleotides 7995-8010 of SEQ ID NO: 1 is selected from ISIS NO. 372859 or 372937.

In certain embodiments, a target region is nucleotides 8336-8356 of SEQ ID NO: 1. In certain such embodiments, a short antisense compound targeted to nucleotides 8336-8356 of SEQ ID NO: 1 comprises a nucleotide sequence selected from SEQ ID NO 114, 115, 116, or 117. In certain such embodiments, a short antisense compound targeted to nucleotides 8336-8356 of SEQ ID NO: 1 is selected from ISIS NO. 372861, 372939, 372862, or 372940.

In certain embodiments, a target region is nucleotides 8539-8554 of SEQ ID NO: 1. In certain such embodiments, a short antisense compound targeted to nucleotides 8539-8554 of SEQ ID NO: 1 comprises a nucleotide sequence selected from SEQ ID NO 118 or 119. In certain such embodiments, a short antisense compound targeted to nucleotides 8539-8554 of SEQ ID NO: 1 is selected from ISIS NO. 372863 or 372941.

In certain embodiments, a target region is nucleotides 9344-9359 of SEQ ID NO: 1. In certain such embodiments, a short antisense compound targeted to nucleotides 9344-9359 of SEQ ID NO: 1 comprises a nucleotide sequence selected from SEQ ID NO 120 or 121. In certain such embodiments, a short antisense compound targeted to nucleotides 9344-9359 of SEQ ID NO: 1 is selected from ISIS NO. 372871 or 372949.

In certain embodiments, a target region is nucleotides 9515-9530 of SEQ ID NO: 1. In certain such embodiments, a short antisense compound targeted to nucleotides 9515-9530 of SEQ ID NO: 1 comprises a nucleotide sequence selected from SEQ ID NO 122 or 123. In certain such embodiments, a short antisense compound targeted to nucleotides 9515-9530 of SEQ ID NO: 1 is selected from ISIS NO. 372872 or 372950.

In certain embodiments, a target region is nucleotides 9794-9809 of SEQ ID NO: 1. In certain such embodiments, a short antisense compound targeted to nucleotides 9794-9809 of SEQ ID NO: 1 comprises a nucleotide sequence selected from SEQ ID NO 124 or 125. In certain such embodiments, a short antisense compound targeted to nucleotides 9794-9809 of SEQ ID NO: 1 is selected from ISIS NO. 372875 or 372953.

In certain embodiments, a target region is nucleotides 10157-10187 of SEQ ID NO: 1. In certain such embodiments, a short antisense compound targeted to nucleotides 10157-10187 of SEQ ID NO: 1 comprises a nucleotide sequence selected from SEQ ID NO 126, 127, 128, 129, 130, 131, 132, or 133. In certain such embodiments, a short antisense compound targeted to nucleotides 10157-10187 of SEQ ID NO: 1 is selected from ISIS NO. 372877, 372955, 372878, 372956, 372879, 372957, 372880, or 372958.

In certain embodiments, a target region is nucleotides 10838-10859 of SEQ ID NO: 1. In certain such embodiments, a short antisense compound targeted to nucleotides 10838-10859 of SEQ ID NO: 1 comprises a nucleotide sequence selected from SEQ ID NO 134, 135, 136, 137, 138, 139, 140, 141, or 142. In certain such embodiments, a short antisense compound targeted to nucleotides 10838-10859 of SEQ ID NO: 1 is selected from ISIS NO. 346619, 346620, 346621, 346622, 346623, 346624, 346625, 346626, or 346627.

In certain embodiments, a target region is nucleotides 13689-13714 of SEQ ID NO: 1. In certain such embodiments, a short antisense compound targeted to nucleotides 13689-13714 of SEQ ID NO: 1 comprises a nucleotide sequence selected from SEQ ID NO 143, 144, 145, 146, 147, or 148. In certain such embodiments, a short antisense compound targeted to nucleotides 13689-13714 of SEQ ID NO: 1 is selected from ISIS NO. 372890, 372968, 372891, 372969, 372892, or 372970.

In certain embodiments, a target region is nucleotides 13907-13928 of SEQ ID NO: 1. In certain such embodiments, a short antisense compound targeted to nucleotides 13907-13928 of SEQ ID NO: 1 comprises a nucleotide sequence selected from SEQ ID NO 149, 150, 151, 152, 153, 154, 155, 156, or 157. In certain such embodiments, a short antisense compound targeted to nucleotides 13907-13928 of SEQ ID NO: 1 is selected from ISIS NO. 346628, 346629, 346630, 346631, 346632, 346633, 346634, 346635, or 346636.

In certain embodiments, a target region is nucleotides 13963-13984 of SEQ ID NO: 1. In certain such embodiments, a short antisense compound targeted to nucleotides 13963-13984 of SEQ ID NO: 1 comprises a nucleotide sequence selected from SEQ ID NO 158, 159, 160, 161, 162, 163, 164, 165, or 166. In certain such embodiments, a short antisense compound targeted to nucleotides 13963-13984 of SEQ ID NO: 1 is selected from ISIS NO. 346637, 346638, 346639, 346640, 346641, 346642, 346643, 346644, or 346645.

In certain embodiments, a target region is nucleotides 14051-14072 of SEQ ID NO: 1. In certain such embodiments, a short antisense compound targeted to nucleotides 14051-14072 of SEQ ID NO: 1 comprises a nucleotide sequence selected from SEQ ID NO 167, 168, 169, 170, 171, 172, 173, 174, or 175. In certain such embodiments, a short antisense compound targeted to nucleotides 14051-14072 of SEQ ID NO: 1 is selected from ISIS NO. 346646, 346647, 346648, 346649, 346650, 346651, 346652, 346653, or 346654.

In certain embodiments, short antisense compounds targeted to an ApoB nucleic acid are 8 to 16, preferably 9 to 15, more preferably 9 to 14, more preferably 10 to 14 nucleotides in length. In certain embodiments, short antisense compounds targeted to an ApoB nucleic acid are 9 to 14 nucleotides in length. In certain embodiments, short antisense compounds targeted to an ApoB nucleic acid are 10 to 14 nucleotides in length. In certain embodiments, such short antisense compounds are short antisense oligonucleotides.

In certain embodiments, short antisense compounds targeted to an ApoB nucleic acid are short gapmers. In certain such embodiments, short gapmers targeted to an ApoB nucleic acid comprise at least one high affinity modification in one or more wings of the compound. In certain embodiments, short antisense compounds targeted to an ApoB nucleic acid comprise 1 to 3 high-affinity modifications in each wing. In certain such embodiments, the nucleosides or nucleotides of the wing comprise a 2' modification. In certain such embodiments, the monomers of the wing are BNA's. In certain such embodiments, the monomers of the wing are selected from α-L-Methyleneoxy (4'-CH$_2$—O-2') BNA, β-D-Methyleneoxy (4'-CH$_2$—O-2') BNA, Ethyleneoxy (4'-(CH$_2$)$_2$—O-2') BNA, Aminooxy (4'-CH$_2$—O—N(R)-2') BNA and Oxyamino (4'-CH$_2$—N(R)—O-2') BNA. In certain embodiments, the monomers of a wing comprise a substituent at the 2' position selected from allyl, amino, azido, thio, O-allyl, O—C$_1$-C$_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), and O—CH$_2$—C(=O)—N(R$_m$)(R$_n$), where each R$_m$ and R$_n$ is, independently, H or substituted or unsubstituted C$_1$-C$_{10}$ alkyl. In certain embodiments, the monomers of a wing are 2'MOE nucleotides.

In certain embodiments, short antisense compounds targeted to an ApoB nucleic acid comprise a gap between the 5' wing and the 3' wing. In certain embodiments the gap comprises five, six, seven, eight, nine, ten, eleven, twelve, thirteen, or fourteen monomers. In certain embodiments, the monomers of the gap are unmodified deoxyribonucleotides. In certain embodiments, the monomers of the gap are unmodified ribonucleotides. In certain embodiments, gap modifications (if any) gap result in an antisense compound that, when bound to its target nucleic acid, supports cleavage by an RNase, including, but not limited to, RNase H.

In certain embodiments, short antisense compounds targeted to an ApoB nucleic acid have uniform monomeric linkages. In certain such embodiments, those linkages are all phosphorothioate linkages. In certain embodiments, the linkages are all phosphodiester linkages. In certain embodiments, short antisense compounds targeted to an ApoB nucleic acid have mixed backbones.

In certain embodiments, short antisense compounds targeted to an ApoB nucleic acid are 8 monomers in length. In certain embodiments, short antisense compounds targeted to an ApoB nucleic acid are 9 monomers in length. In certain embodiments, short antisense compounds targeted to an ApoB nucleic acid are 10 monomers in length. In certain embodiments, short antisense compounds targeted to an ApoB nucleic acid are 11 monomers in length. In certain embodiments, short antisense compounds targeted to an ApoB nucleic acid are monomers in length. In certain embodiments, short antisense compounds targeted to an ApoB nucleic acid are 13 monomers in length. In certain embodiments, short antisense compounds targeted to an ApoB nucleic acid are 14 monomers in length. In certain embodiments, short antisense compounds targeted to an ApoB nucleic acid are 15 monomers in length. In certain embodiments, short antisense compounds targeted to an ApoB nucleic acid are 16 monomers in length. In certain embodiments, short antisense compounds targeted to an ApoB nucleic acid comprise 9 to 15 monomers. In certain embodiments, short antisense compounds targeted to an ApoB nucleic acid comprise 10 to 15 monomers. In certain embodiments, short antisense compounds targeted to an ApoB nucleic acid comprise 12 to 14 monomers. In certain embodiments, short antisense compounds targeted to an ApoB nucleic acid comprise 12 to 14 nucleotides or nucleosides.

In certain embodiments, the invention provides methods of modulating expression of ApoB. In certain embodiments, such methods comprise use of one or more short antisense compound targeted to an ApoB nucleic acid, wherein the short antisense compound targeted to an ApoB nucleic acid is from about 8 to about 16, preferably 9 to 15, more preferably 9 to 14, more preferably 10 to 14 monomers (i.e. from about 8 to about 16 linked monomers). One of ordinary skill in the art will appreciate that this comprehends methods of modulating expression of ApoB using one or more short antisense compounds targeted to an ApoB nucleic acid of 8, 9, 10, 11, 12, 13, 14, 15 or 16 monomers.

In certain embodiments, methods of modulating ApoB comprise use of a short antisense compound targeted to an ApoB nucleic acid that is 8 monomers in length. In certain embodiments, methods of modulating ApoB comprise use of a short antisense compound targeted to an ApoB nucleic acid that is 9 monomers in length. In certain embodiments, methods of modulating ApoB comprise use of a short antisense compound targeted to an ApoB nucleic acid that is 10 monomers in length. In certain embodiments, methods of modulating ApoB comprise use of a short antisense compound targeted to an ApoB nucleic acid that is 11 monomers in length. In certain embodiments, methods of modulating ApoB comprise use of a short antisense compound targeted to an ApoB nucleic acid that is 12 monomers in length. In certain embodiments, methods of modulating ApoB comprise use of a short antisense compound targeted to an ApoB nucleic acid that is 13 monomers in length. In certain embodiments, methods of modulating ApoB comprise use of a short antisense compound targeted to an ApoB nucleic acid that is 14 monomers in length. In certain embodiments, methods of modulating ApoB comprise use of a short antisense compound targeted to an ApoB nucleic acid that is 15 monomers in length. In certain embodiments, methods of modulating ApoB comprise use of a short antisense compound targeted to an ApoB nucleic acid that is 16 monomers in length.

In certain embodiments, methods of modulating expression of ApoB comprise use of a short antisense compound targeted to an ApoB nucleic acid comprising 9 to 15 monomers. In certain embodiments, methods of modulating expression of ApoB comprise use of a short antisense compound targeted to an ApoB nucleic acid comprising 10 to 15 monomers. In certain embodiments, methods of modulating expression of ApoB comprise use of a short antisense compound targeted to an ApoB nucleic acid comprising 12 to 14 monomers. In certain embodiments, methods of modulating expression of ApoB comprise use of a short antisense compound targeted to an ApoB nucleic acid comprising 12 or 14 nucleotides or nucleosides.

In certain embodiments, short antisense compounds targeting a ApoB nucleic acid may have any one or more properties or characteristics of the short antisense compounds generally described herein. In certain embodiments, short antisense compounds targeting a ApoB nucleic acid have a motif (wing-deoxy gap-wing) selected from 1-12-1, 1-1-10-2, 2-10-1-1, 3-10-3, 2-10-3, 2-10-2, 1-10-1, 1-10-2, 3-8-3, 2-8-2, 1-8-1, 3-6-3 or 1-6-1, more preferably 1-10-1, 2-10-2, 3-10-3, and 1-9-2.

2. SGLT-2

Sodium dependent glucose transporter 2 (SGLT-2) is expressed in the kidney proximal tubule epithelial cells, and functions to reabsorb glucose preventing glucose loss in the urine. For the human genome SGLT-2 is a member of an 11-membered family of sodium substrate co-transporters. Many of these family members share sequence homology, for example SGLT-1 shares about 59% sequence identity with SGLT-2 and about 70% sequence identity with SGLT-3. SGLT-1 is a glucose transporter found in the heart and the CNS. SGLT-3 is a glucose sensing sodium channel in the small intestine. The separate localization patterns for these SGLTs is one point of distinction between the homologous family members. (Handlon, A. L., Expert Opin. Ther. Patents (2005) 15(11):1532-1540; Kanai et al., J. Clin. Invest., 1994, 93, 397-404; Wells et al., Am. J. Physiol. Endocrinol. Metab., 1992, 263, F459-465).

Studies of human SGLT2 injected into Xenopus oocytes demonstrated that this protein mediates sodium-dependent transport of D-glucose and .alpha.-methyl-D-glucopyranoside (.alpha.-MeGlc; a glucose analog) with a Km value of 1.6 mM for .alpha.-MeGlc and a sodium to glucose coupling ratio of 1:1 (Kanai et al., J. Clin. Invest., 1994, 93, 397-404; You et al., J. Biol. Chem., 1995, 270, 29365-29371). This transport activity was suppressed by phlorizin, a plant glycoside that binds to the glucose site of the SGLTs but is not transported and thus inhibits SGLT action (You et al., J. Biol. Chem., 1995, 270, 29365-29371).

Diabetes is a disorder characterized by hyperglycemia due to deficient insulin action. Chronic hyperglycemia is a major risk factor for diabetes-associated complications, including heart disease, retinopathy, nephropathy and neuropathy. As the kidneys play a major role in the regulation of plasma glucose levels, renal glucose transporters are becoming attractive drug targets (Wright, Am. J. Physiol. Renal Physiol., 2001, 280, F10-18). Diabetic nephropathy is the most common cause of end-stage renal disease that develops in many patients with diabetes. Glucotoxicity, which results from long-term hyperglycemia, induces tissue-dependent insulin resistance in diabetic patients (Nawano et al., Am. J. Physiol. Endocrinol. Metab., 2000, 278, E535-543).

Definitions

"Sodium dependent glucose transporter 2" is the gene product or protein of which expression is to be modulated by administration of a short antisense compound. Sodium dependent glucose transporter 2 is generally referred to as SGLT2 but may also be referred to as SLC5A2; sodium-glucose transporter 2; sodium-glucose cotransporter, kidney low affinity; sodium-glucose cotransporter, renal; solute carrier family 5 (sodium/glucose cotransporter), member 2; SL52.

"SGLT2 nucleic acid" means any nucleic acid encoding SGLT2. For example, in certain embodiments, a SGLT2 nucleic acid includes, without limitation, a DNA sequence encoding SGLT2, an RNA sequence transcribed from DNA encoding SGLT2, and an mRNA sequence encoding SGLT2. "SGLT2 mRNA" means an mRNA encoding a SGLT2 protein.

Therapeutic Indications

In certain embodiments, short antisense compounds are used to modulate expression of SGLT-2 and related proteins. In certain embodiments, such modulation is accomplished by providing short antisense compounds that hybridize with one or more target nucleic acid molecules encoding SGLT-2, including, but is not limited to, SGLT2, SL52, SLC5A2, Sodium-Glucose Co-Transporter, Kidney Low Affinity Sodium-Glucose Co-Transporter, Renal Sodium-Glucose Co-Transporter 2 and Solute Carrier Family 5 Sodium/Glucose Co-Transporter Member 2. Also provided are methods of treating metabolic and/or cardiovascular disease and disorders as described herein. In particular embodiments, short antisense compounds that inhibit the expression of SGLT2 are used in methods of lowering blood glucose levels in an animal and methods of delaying or preventing the onset of type 2 diabetes. Such methods comprise administering a therapeutically or prophylactically effective amount of one or more of the compounds of the invention to the animal, which may be in need of treatment. The one or more compounds can be a short antisense compound targeting a nucleic acid encoding SGLT2. Provided herein are methods of enhancing inhibition of expression of SGLT2 in kidney cells or kidney tissues, comprising contacting the cells or tissues with one or more of the compounds of the invention, such as short antisense compounds targeting a nucleic acid encoding SGLT2.

While certain compounds, compositions and methods have been described with specificity in accordance with certain embodiments, the following examples serve only to illustrate the compounds of the invention and are not intended to limit the same.

In certain embodiments, short antisense compounds are chimeric oligomeric compounds having mixed phosphorothioate and phosphodiester backbones. Certain mixed backbone short antisense compounds have a central gap comprising at least 5 contiguous 2'-deoxy nucleosides flanked by two wings each of which comprises at least one 2'-O-methoxyethyl nucleoside. In certain embodiments, the internucleoside linkages of the mixed backbone compounds are phosphorothioate linkages in the gap and phosphodiester linkages in the two wings. In certain embodiments, mixed backbone compounds have phosphorothioate linkages in the wings, except for one phosphodiester linkage at one or both of the extreme 5' and 3' ends of the oligonucleotide. In certain embodiments short antisense compounds targeted to SGLT2 have a motif (wing-deoxy gap-wing) selected from 3-10-3, 2-10-3, 2-10-2, 1-10-1, 1-10-2, 2-8-2, 1-9-2, 1-8-1, 3-6-3 or 1-6-1. In certain embodiments short antisense compounds targeted to SGLT2 have a motif (wing-deoxy gap-wing) selected from 1-10-1, 1-10-2, 2-8-2, 1-9-2, 1-8-1, 3-6-3 or 1-6-1.

In certain embodiments, short antisense compounds targeted to an SGLT2 nucleic acid and having a mixed backbone are efficiently delivered to the kidney. In certain embodiments, administration of short antisense compounds targeted to an SGLT2 nucleic acid and having a mixed backbone results in modulation of target gene expression in the kidney. In certain such embodiments, there is little or no liver or kidney toxicity. In certain embodiments, short antisense compounds targeted to an SGLT2 nucleic acid and having a mixed backbone are more potent for reducing SGLT-2 mRNA and have a faster onset compared with a short antisense compound that does not have a mixed back-bone, but is otherwise identical. In certain such embodiments, such increase potency and/or reduced toxicity is in mouse and/or rat. In certain such embodiments, such increase potency and/or reduced toxicity is in a human.

By way of example, and only for illustrative purposes, ISIS 145733, which comprises uniform phosphorothioate linkages and ISIS 257016 which comprises phosphodiester linkage in the wings and phosphorothioate linkages in the gap, are otherwise identical. Both comprise the sequence GAAGTAGC-CACCAACTGTGC (SEQ ID NO. 1572). Both of the oligonucleotides further comprise a gap consisting of ten 2'-deoxynucleotides, flanked on each side by five-nucleotide "2'-methoxyethyl (2'-MOE) nucleotides. All cytidine residues are 5-methylcytidines. The mixed back-bone compound, ISIS 257016, was about 50 times more potent for reducing SGLT-2 mRNA compared to the non-mixed parent compound, ISIS 145733 (see EXAMPLE 9).

Pharmacokinetic studies of certain mixed backbone compound ISIS 257016 indicate that in certain embodiments, the compound acts as a prodrug that is metabolized to a 12 nucleobase pharmacophore. Studies with ISIS 370717, a 12 nucleobase short antisense compound corresponding to ISIS 257016, show that the compound has a similar pharmacological profile to ISIS 257016 but with a faster onset of action. ISIS 370717 is a 12 nucleobase antisense oligonucleotide targeted to SGLT-2 comprising the sequence TAGCCAC-CAACT (SEQ ID NO. 1554), further comprising a gap consisting of ten 2'-deoxynucleotides, flanked on both sides by one-nucleotide wings. The wings are composed of 2'-methoxyethyl (2'-MOE) nucleotides. All cytidine residues are 5-methylcytidines. The internucleoside linkages are phosphorothioate (P=S) throughout the oligonucleotide. The similarity in pharmacological activity of ISIS 257016 and ISIS 370717 supports the pharmacokinetic studies indicating ISIS 257016 was a prodrug having a 12 nucleotide pharmacophore (see EXAMPLE 10). Further, studies with stabilized (end-capped) versions of ISIS 257016 show dramatic loss of activity.

In certain embodiments, short antisense compounds comprising 2' MOE monomers in the wings are efficiently delivered to the kidney and treatment with such compounds results in efficient modulation of target gene expression in the kidney without liver or kidney toxicity. It is further shown herein that in certain embodiments, short antisense compounds are more potent for reducing SGLT-2 mRNA and have a faster onset compared with parent oligonucleotides targeted to SGLT-2 mRNA in mouse and rat. 2' MOE gap shortmers are shown herein to improve potency and bioavailability over parent compounds.

By way of example, and only for illustrative purposes studies with ISIS 370717 reveal significantly higher accumulation of the short antisense compound in the kidney tissue (approximately 500 micro grams per gram of tissue) compared to the longer parent. Moreover, SGLT-2 mRNA was reduced by more than 80% over the controls (see EXAMPLE 11). ISIS 370717 1-10-1 gapmer was used as a template to make sequence related oligos with varying motifs. Studies evaluating wing, gap and total length variations around the ISIS 370717 12 mer oligonucleotide can be seen in EXAMPLE 12. Certain motifs evaluated included 1-10-1, 2-8-2, 1-8-1, 3-6-3, and 1-6-1 (see Table 60 in EXAMPLE 12). The compounds were analyzed for their effect on SGLT2 mRNA levels. All the motifs inhibited the expression of SGLT2 in vivo in a dose-dependent manner. The 1-10-1, 2-8-2 and 1-8-1 gapmers were found to be particularly potent. SGLT-2 mRNA was reduced by more than 80% over the controls using these motifs.

In certain embodiments, the invention provides short antisense compounds targeted to an SGLT2 nucleic acid and having a motif selected from: 1-10-1 and 1-10-2 MOE gapmer. (see Table 62 in EXAMPLE 13). Certain such compounds were analyzed for their effect on rat SGLT2 mRNA. Results in Table 63 illustrate that both the 1-10-1 and 1-10-2 MOE gapmers inhibit the expression of SGLT2 in vivo in a dose-dependent manner and over 80% reduction of SGLT-2 mRNA could be achieved.

Certain additional 1-10-1 and 2-8-2 MOE gapmers were evaluated in both mouse and rat in vivo models (see, e.g., EXAMPLE 14 and 15). Greater than 80% reduction in SGLT-2 mRNA was achieved with many of the 1-10-1 and 2-8-2 MOE gapmers at relatively low concentrations of oligo and in the absence of any toxicity effects.

In another non-limiting example, the effect of ISIS 388625 on dog SGLT2 mRNA levels was also analyzed. Dog studies illustrate that greater than 80% inhibition of the expression of SGLT2 can be achieved at a 1 mg/kg/wk dose. Even greater inhibition can be achieved at slightly higher doses. Administration of ISIS 388625 in dog was also shown to improved glucose tolerance. Peak plasma glucose levels were decreased by over 50% on average and the subsequent drop in glucose was lessened compared to saline controls in a standard glucose tolerance test (See EXAMPLE 17). Also, in a rat model of diabetes, short antisense compounds were shown to significantly decrease plasma glucose levels and HbA1C over time compared to PBS and control treated animals (See Example 16).

The animals in all studies were further evaluated for toxicity. For example, total body weight, liver, spleen and kidney weight were evaluated. Significant changes in spleen, liver or body weight can indicate that a particular compound causes toxic effects. All changes were found to be within the margin of error. No significant changes in body weight were observed during the treatment or at study termination. No significant changes in liver or spleen weights were observed.

Certain Short Antisense Compounds Targeted to an SGLT2 Nucleic Acid

In certain embodiments, short antisense compounds are targeted to an SGLT2 nucleic acid having the sequence of GENBANK® Accession No. NM_003041.1, incorporated herein as SEQ ID NO: 3. In certain such embodiments, a short antisense compound targeted to SEQ ID NO: 3 is at least 90% complementary to SEQ ID NO: 3. In certain such embodiments, a short antisense compound targeted to SEQ ID NO: 3 is at least 95% complementary to SEQ ID NO: 3. In certain such embodiments, a short antisense compound targeted to SEQ ID NO: 3 is 100% complementary to SEQ ID NO: 1. In certain embodiments, a short antisense compound targeted to SEQ ID NO: 3 comprises a nucleotide sequence selected from the nucleotide sequences set forth in Table 4 and 5.

The nucleotide sequence set forth in each SEQ ID NO set forth in Tables 4 and 5 is independent of any modification to a sugar moiety, a monomeric linkage, or a nucleobase. As such, short antisense compounds defined by a SEQ ID NO may comprise, independently, one or more modifications to a sugar moiety, an internucleoside linkage, or a nucleobase. Antisense compounds described by Isis Number (Isis NO.) indicate a combination of nucleobase sequence and one or more modifications to a sugar moiety, an internucleoside linkage, or a nucleobase.

Tables 4 and 5 illustrate examples of short antisense compounds targeted to SEQ ID NO: 3. Table 4 illustrates short antisense compounds that are 100% complementary to SEQ ID NO: 3. Table 5 illustrates short antisense compounds that have one or two mismatches with respect to SEQ ID NO: 3. The column labeled 'gapmer motif' indicates the wing-gap-wing motif of each short antisense compounds. The gap segment comprises 2'-deoxynucleotides and each nucleotide of each wing segment comprises a 2'-modified sugar. The particular 2'-modified sugar is also indicated in the 'gapmer motif' column. For example, '2-10-2 MOE' means a 2-10-2 gapmer motif, where a gap segment of ten 2'-deoxynucleotides is flanked by wing segments of two nucleotides, where the nucleotides of the wing segments are 2'-MOE nucleotides. Internucleoside linkages are phosphorothioate. The short antisense compounds comprise 5-methylcytidine in place of unmodified cytosine, unless "unmodified cytosine" is listed in the gapmer motif column, in which case the indicated cytosines are unmodified cytosines. For example, "5-mC in gap only" indicates that the gap segment has 5-methylcytosines, while the wing segments have unmodified cytosines.

TABLE 4

Short Antisense Compounds Targeted to SEQ ID NO: 3

| ISIS No | 5' Target Site | 3' Target Site | Sequence (5'-3') | Gapmer Motif | SEQ ID NO |
|---|---|---|---|---|---|
| 379684 | 84 | 95 | TGTCAGCAGGAT | 1-10-1 MOE | 214 |
| 405193 | 113 | 124 | CAGCAGGAAATA | 2-8-2 MOE | 215 |
| 405194 | 114 | 125 | CCAGCAGGAAAT | 2-8-2 MOE | 216 |
| 405195 | 115 | 126 | ACCAGCAGGAAA | 2-8-2 MOE | 217 |
| 405196 | 116 | 127 | GACCAGCAGGAA | 2-8-2 MOE | 218 |
| 405197 | 117 | 128 | TGACCAGCAGGA | 2-8-2 MOE | 219 |
| 379685 | 117 | 128 | TGACCAGCAGGA | 1-10-1 MOE | 219 |
| 405198 | 118 | 129 | ATGACCAGCAGG | 2-8-2 MOE | 221 |
| 405199 | 119 | 130 | AATGACCAGCAG | 2-8-2 MOE | 222 |
| 405200 | 120 | 131 | CAATGACCAGCA | 2-8-2 MOE | 223 |
| 405201 | 121 | 132 | CCAATGACCAGC | 2-8-2 MOE | 224 |
| 379686 | 135 | 146 | ACCACAAGCCAA | 1-10-1 MOE | 225 |
| 379711 | 172 | 183 | TAGCCGCCCACA | 1-10-1 MOE | 226 |
| 388628 | 172 | 183 | TAGCCGCCCACA | 2-8-2 MOE | 226 |
| 405202 | 207 | 218 | CCGGCCACCACA | 2-8-2 MOE | 228 |
| 405203 | 208 | 219 | ACCGGCCACCAC | 2-8-2 MOE | 229 |
| 405204 | 236 | 247 | GATGTTGCTGGC | 2-8-2 MOE | 230 |
| 379687 | 236 | 247 | GATGTTGCTGGC | 1-10-1 MOE | 230 |
| 405205 | 237 | 248 | CGATGTTGCTGG | 2-8-2 MOE | 232 |
| 405206 | 238 | 249 | CCGATGTTGCTG | 2-8-2 MOE | 233 |
| 405207 | 239 | 250 | GCCGATGTTGCT | 2-8-2 MOE | 234 |
| 405208 | 240 | 251 | TGCCGATGTTGC | 2-8-2 MOE | 235 |
| 405209 | 241 | 252 | CTGCCGATGTTG | 2-8-2 MOE | 236 |
| 405210 | 260 | 271 | CAGGCCCACAAA | 2-8-2 MOE | 237 |
| 405211 | 261 | 272 | CCAGGCCCACAA | 2-8-2 MOE | 238 |
| 405212 | 262 | 273 | GCCAGGCCCACA | 2-8-2 MOE | 239 |
| 379688 | 288 | 299 | CCAAGCCACTTG | 1-10-1 MOE | 240 |
| 379689 | 318 | 329 | AGAGCGCATTCC | 1-10-1 MOE | 241 |
| 379690 | 435 | 446 | ACAGGTAGAGGC | 1-10-1 MOE | 242 |
| 405248 | 474 | 485 | AGATCTTGGTGA | 2-8-2 MOE | 243 |
| 379691 | 474 | 485 | AGATCTTGGTGA | 1-10-1 MOE | 243 |
| 382676 | 527 | 539 | TGTTCCAGCCCAG | 1-10-2 MOE | 245 |
| 388625 | 528 | 539 | TGTTCCAGCCCA | 2-8-2 MOE | 246 |
| 389780 | 528 | 539 | TGTTCCAGCCCA | 1-9-2 MOE | 246 |
| 379692 | 528 | 539 | TGTTCCAGCCCA | 1-10-1 MOE | 246 |
| 392170 | 528 | 539 | TGTTCCAGCCCA | 1-10-1 Methyleneoxy BNA | 246 |
| 392173 | 528 | 539 | TGTTCCAGCCCA | 2-8-2 Methyleneoxy BNA | 246 |
| 405213 | 529 | 540 | ATGTTCCAGCCC | 2-8-2 MOE | 251 |
| 405214 | 564 | 575 | TGGTGATGCCCA | 2-8-2 MOE | 252 |
| 405215 | 565 | 576 | ATGGTGATGCCC | 2-8-2 MOE | 253 |
| 405216 | 566 | 577 | CATGGTGATGCC | 2-8-2 MOE | 254 |
| 379693 | 566 | 577 | CATGGTGATGCC | 1-10-1 MOE | 254 |
| 405217 | 567 | 578 | TCATGGTGATGC | 2-8-2 MOE | 256 |
| 405218 | 568 | 579 | ATCATGGTGATG | 2-8-2 MOE | 257 |
| 405219 | 587 | 598 | CCCTCCTGTCAC | 2-8-2 MOE | 258 |
| 405220 | 588 | 599 | GCCCTCCTGTCA | 2-8-2 MOE | 259 |
| 405221 | 589 | 600 | AGCCCTCCTGTC | 2-8-2 MOE | 260 |
| 405222 | 590 | 601 | CAGCCCTCCTGT | 2-8-2 MOE | 261 |
| 405223 | 591 | 602 | CCAGCCCTCCTG | 2-8-2 MOE | 262 |
| 405224 | 592 | 603 | GCCAGCCCTCCT | 2-8-2 MOE | 263 |
| 379694 | 629 | 640 | GACGAAGGTCTG | 1-10-1 MOE | 264 |
| 405225 | 707 | 718 | GTATTTGTCGAA | 2-8-2 MOE | 265 |
| 379695 | 737 | 748 | GGACACCGTCAG | 1-10-1 MOE | 266 |
| 379696 | 974 | 985 | CAGCTTCAGGTA | 1-10-1 MOE | 267 |
| 405226 | 998 | 1009 | CATGACCATGAG | 2-8-2 MOE | 268 |
| 405227 | 999 | 1010 | GCATGACCATGA | 2-8-2 MOE | 269 |
| 405228 | 1000 | 1011 | GGCATGACCATG | 2-8-2 MOE | 270 |
| 405229 | 1001 | 1012 | TGGCATGACCAT | 2-8-2 MOE | 271 |
| 405230 | 1002 | 1013 | CTGGCATGACCA | 2-8-2 MOE | 272 |
| 379697 | 1002 | 1013 | CTGGCATGACCA | 1-10-1 MOE | 272 |
| 405231 | 1003 | 1014 | CCTGGCATGACC | 2-8-2 MOE | 274 |
| 379698 | 1091 | 1102 | GCAGCCCACCTC | 1-10-1 MOE | 275 |
| 405232 | 1092 | 1103 | AGCAGCCCACCT | 2-8-2 MOE | 276 |
| 405233 | 1093 | 1104 | GAGCAGCCCACC | 2-8-2 MOE | 277 |
| 405234 | 1130 | 1141 | CATGAGCTTCAC | 2-8-2 MOE | 278 |
| 405235 | 1131 | 1142 | GCATGAGCTTCA | 2-8-2 MOE | 279 |
| 382677 | 1131 | 1143 | GGCATGAGCTTCA | 1-10-2 MOE | 280 |
| 388626 | 1132 | 1143 | GGCATGAGCTTC | 2-8-2 MOE | 281 |
| 379699 | 1132 | 1143 | GGCATGAGCTTC | 1-10-1 MOE | 281 |

TABLE 4-continued

Short Antisense Compounds Targeted to SEQ ID NO: 3

| ISIS No | 5' Target Site | 3' Target Site | Sequence (5'-3') | Gapmer Motif | SEQ ID NO |
|---|---|---|---|---|---|
| 405236 | 1133 | 1144 | GGGCATGAGCTT | 2-8-2 MOE | 283 |
| 405237 | 1157 | 1168 | CAGCATGAGTCC | 2-8-2 MOE | 284 |
| 405238 | 1158 | 1169 | CCAGCATGAGTC | 2-8-2 MOE | 285 |
| 379700 | 1158 | 1169 | CCAGCATGAGTC | 1-10-1 MOE | 285 |
| 405239 | 1159 | 1170 | GCCAGCATGAGT | 2-8-2 MOE | 287 |
| 379701 | 1230 | 1241 | CCATGGTGAAGA | 1-10-1 MOE | 288 |
| 405240 | 1542 | 1553 | CACAGCTGCCCG | 2-8-2 MOE | 289 |
| 405241 | 1543 | 1554 | ACACAGCTGCCC | 2-8-2 MOE | 290 |
| 405242 | 1544 | 1555 | CACACAGCTGCC | 2-8-2 MOE | 291 |
| 382678 | 1544 | 1556 | GCACACAGCTGCC | 1-10-2 MOE | 292 |
| 388627 | 1545 | 1556 | GCACACAGCTGC | 2-8-2 MOE | 293 |
| 379702 | 1545 | 1556 | GCACACAGCTGC | 1-10-1 MOE | 293 |
| 379703 | 1701 | 1712 | GCCGGAGACTGA | 1-10-1 MOE | 295 |
| 405243 | 1976 | 1987 | ATTGAGGTTGAC | 2-8-2 MOE | 296 |
| 405244 | 1977 | 1988 | CATTGAGGTTGA | 2-8-2 MOE | 297 |
| 405245 | 1978 | 1989 | GCATTGAGGTTG | 2-8-2 MOE | 298 |
| 405246 | 1979 | 1990 | GGCATTGAGGTT | 2-8-2 MOE | 299 |
| 405247 | 1980 | 1991 | GGGCATTGAGGT | 2-8-2 MOE | 300 |

TABLE 5

Short antisense compounds targeted to SEQ ID NO: 3 and having 1 or 2 mismatches

| ISIS No | 5' Target Site | 3' Target Site | Sequence (5'-3') | Gapmer Motif | SEQ ID NO |
|---|---|---|---|---|---|
| 405200 | 96 | 107 | CAATGACCAGCA | 2-8-2 MOE | 223 |
| 405215 | 382 | 393 | ATGGTGATGCCC | 2-8-2 MOE | 253 |
| 405216 | 383 | 394 | CATGGTGATGCC | 2-8-2 MOE | 254 |
| 379693 | 383 | 394 | CATGGTGATGCC | 1-10-1 MOE | 254 |
| 379701 | 471 | 482 | CCATGGTGAAGA | 1-10-1 MOE | 288 |
| 405218 | 472 | 483 | ATCATGGTGATG | 2-8-2 MOE | 257 |
| 405246 | 536 | 547 | GGCATTGAGGTT | 2-8-2 MOE | 299 |
| 405248 | 570 | 581 | AGATCTTGGTGA | 2-8-2 MOE | 243 |
| 379691 | 570 | 581 | AGATCTTGGTGA | 1-10-1 MOE | 243 |
| 379698 | 683 | 694 | GCAGCCCACCTC | 1-10-1 MOE | 275 |
| 405232 | 684 | 695 | AGCAGCCCACCT | 2-8-2 MOE | 276 |
| 379711 | 685 | 696 | TAGCCGCCCACA | 1-10-1 MOE | 226 |
| 388628 | 685 | 696 | TAGCCGCCCACA | 2-8-2 MOE | 226 |
| 379698 | 950 | 961 | GCAGCCCACCTC | 1-10-1 MOE | 275 |
| 405232 | 951 | 962 | AGCAGCCCACCT | 2-8-2 MOE | 276 |
| 405235 | 978 | 989 | GCATGAGCTTCA | 2-8-2 MOE | 279 |
| 382677 | 978 | 990 | GGCATGAGCTTCA | 1-10-2 MOE | 280 |
| 388626 | 979 | 990 | GGCATGAGCTTC | 2-8-2 MOE | 281 |
| 379699 | 979 | 990 | GGCATGAGCTTC | 1-10-1 MOE | 281 |
| 405236 | 980 | 991 | GGGCATGAGCTT | 2-8-2 MOE | 283 |
| 379698 | 1043 | 1054 | GCAGCCCACCTC | 1-10-1 MOE | 275 |
| 405239 | 1171 | 1182 | GCCAGCATGAGT | 2-8-2 MOE | 287 |
| 405209 | 1213 | 1224 | CTGCCGATGTTG | 2-8-2 MOE | 236 |
| 405233 | 1364 | 1375 | GAGCAGCCCACC | 2-8-2 MOE | 277 |
| 405240 | 1366 | 1377 | CACAGCTGCCCG | 2-8-2 MOE | 289 |
| 405211 | 1500 | 1511 | CCAGGCCCACAA | 2-8-2 MOE | 238 |
| 405212 | 1501 | 1512 | GCCAGGCCCACA | 2-8-2 MOE | 239 |
| 379695 | 1643 | 1654 | GGACACCGTCAG | 1-10-1 MOE | 266 |
| 379698 | 1875 | 1886 | GCAGCCCACCTC | 1-10-1 MOE | 275 |
| 405239 | 1993 | 2004 | GCCAGCATGAGT | 2-8-2 MOE | 287 |
| 405211 | 2210 | 2221 | CCAGGCCCACAA | 2-8-2 MOE | 238 |
| 405212 | 2211 | 2222 | GCCAGGCCCACA | 2-8-2 MOE | 239 |

In certain embodiments, a target region is nucleotides 85-184 of SEQ ID NO: 3. In certain embodiments, a short antisense compound is targeted to nucleotides 85-184 of SEQ ID NO: 3. In certain such embodiments, a short antisense compound targeted to nucleotides 85-184 comprises a nucleotide sequence selected from SEQ ID NO 214, 215, 216, 217, 218, 219, 221, 222, 223, 224, 225, or 227. In certain such embodiments, a short antisense compound targeted to nucleotides 85-184 of SEQ ID NO: 3 is selected from Isis No 379684, 405193, 405194, 405195, 405196, 405197, 379685, 405198, 405199, 405200, 405201, 379686, 379711 or 388628.

In certain embodiments, a target region is nucleotides 113-132 of SEQ ID NO: 3. In certain embodiments, a short antisense compound is targeted to nucleotides 113-132 of SEQ ID NO: 3. In certain such embodiments, a short antisense compound targeted to nucleotides 113-132 comprises a nucleotide sequence selected from SEQ ID NO 215, 216, 217, 218, 219, 221, 222, 223, or 224. In certain such embodiments, a short antisense compound targeted to nucleotides 113-132 of SEQ ID NO: 3 is selected from Isis No 405193, 405194, 405195, 405196, 405197, 379685, 405198, 405199, 405200, or 405201.

In certain embodiments, a target region is nucleotides 207-329 of SEQ ID NO: 3. In certain embodiments, a short antisense compound is targeted to nucleotides 207-329 of SEQ ID NO: 3. In certain such embodiments, a short antisense compound targeted to nucleotides 207-329 comprises a nucleotide sequence selected from SEQ ID NO 228, 229, 230, 232, 233, 234, 235, 236, 237, 238, 239, 240, or 241. In certain such embodiments, a short antisense compound targeted to nucleotides 207-329 of SEQ ID NO: 3 is selected from Isis No 405202, 405203, 405204, 379687, 405205, 405206, 405207, 405208, 405209, 405210, 405211, 405212, 379688, or 379689.

In certain embodiments, a target region is nucleotides 207-273 of SEQ ID NO: 3. In certain embodiments, a short antisense compound is targeted to nucleotides 207-273 of SEQ ID NO: 3. In certain such embodiments, a short antisense compound targeted to nucleotides 207-273 comprises a nucleotide sequence selected from SEQ ID NO 228, 229, 230, 232, 233, 234, 235, 236, 237, 238, or 239. In certain such embodiments, a short antisense compound targeted to nucleotides 207-273 of SEQ ID NO: 3 is selected from Isis No 405202, 405203, 405204, 379687, 405205, 405206, 405207, 405208, 405209, 405210, 405211, or 405212.

In certain embodiments, a target region is nucleotides 207-219 of SEQ ID NO: 3. In certain embodiments, a short antisense compound is targeted to nucleotides 207-219 of SEQ ID NO: 3. In certain such embodiments, a short antisense compound targeted to nucleotides 207-219 comprises a nucleotide sequence selected from SEQ ID NO 228 or 229. In certain such embodiments, a short antisense compound targeted to nucleotides 207-219 of SEQ ID NO: 3 is selected from Isis NO. 405202 or 405203.

In certain embodiments, a target region is nucleotides 236-252 of SEQ ID NO: 3. In certain embodiments, a short antisense compound is targeted to nucleotides 236-252 of SEQ ID NO: 3. In certain such embodiments, a short antisense compound targeted to nucleotides 236-252 comprises a nucleotide sequence selected from SEQ ID NO 230, 232, 233, 234, 235, or 236. In certain such embodiments, a short antisense compound targeted to nucleotides 236-252 of SEQ ID NO: 3 is selected from Isis NO. 405204, 379687, 405205, 405206, 405207, 405208, or 405209.

In certain embodiments, a target region is nucleotides 260-273 of SEQ ID NO: 3. In certain embodiments, a short antisense compound is targeted to nucleotides 260-273 of SEQ ID NO: 3. In certain such embodiments, a short antisense compound targeted to nucleotides 260-273 comprises a nucleotide sequence selected from SEQ ID NO 237, 238, or 239. In certain such embodiments, a short antisense compound targeted to nucleotides 260-273 of SEQ ID NO: 3 is selected from Isis NO. 405210, 405211, or 405212.

In certain embodiments, a target region is nucleotides 435-640 of SEQ ID NO: 3. In certain embodiments, a short antisense compound is targeted to nucleotides 435-640 of SEQ ID NO: 3. In certain such embodiments, a short antisense compound targeted to nucleotides 435-640 comprises a nucleotide sequence selected from SEQ ID NO 242, 243, 245, 246, 251, 252, 253, 254, 256, 257, 258, 259, 260, 261, 262, 263, or 264. In certain such embodiments, a short antisense compound targeted to nucleotides 435-640 of SEQ ID NO: 3 is selected from Isis NO. 379690, 405248, 379691, 389780, 379692, 382676, 388625, 392170, 392173, 405213, 405214, 405215, 405216, 379693, 405217, 405218, 405219, 405220, 405221, 405222, 405223, 405224, or 379694.

In certain embodiments, a target region is nucleotides 527-540 of SEQ ID NO: 3. In certain embodiments, a short antisense compound is targeted to nucleotides 527-540 of SEQ ID NO: 3. In certain such embodiments, a short antisense compound targeted to nucleotides 527-540 comprises a nucleotide sequence selected from SEQ ID NO 245, 246, or 251. In certain such embodiments, a short antisense compound targeted to nucleotides 527-540 of SEQ ID NO: 3 is selected from Isis NO. 389780, 379692, 382676, 388626, 392170, 392173, or 405213.

In certain embodiments, a target region is nucleotides 564-603 of SEQ ID NO: 3. In certain embodiments, a short antisense compound is targeted to nucleotides 564-603 of SEQ ID NO: 3. In certain such embodiments, a short antisense compound targeted to nucleotides 564-603 comprises a nucleotide sequence selected from SEQ ID NO 252, 253, 254, 256, 257, 258, 259, 260, 261, 262, or 263. In certain such embodiments, a short antisense compound targeted to nucleotides 564-603 of SEQ ID NO: 3 is selected from Isis NO. 405214, 405215, 405216, 379693, 405217, 405218, 405219, 405220, 405221, 405222, 405223, or 405224.

In certain embodiments, a target region is nucleotides 564-579 of SEQ ID NO: 3. In certain embodiments, a short antisense compound is targeted to nucleotides 564-579 of SEQ ID NO: 3. In certain such embodiments, a short antisense compound targeted to nucleotides 564-579 comprises a nucleotide sequence selected from SEQ ID NO 252, 253, 254, 256, or 257. In certain such embodiments, a short antisense compound targeted to nucleotides 564-579 of SEQ ID NO: 3 is selected from Isis NO. 405214, 405215, 405216, 379693, 405217, or 405218.

In certain embodiments, a target region is nucleotides 587-603 of SEQ ID NO: 3. In certain embodiments, a short antisense compound is targeted to nucleotides 587-603 of SEQ ID NO: 3. In certain such embodiments, a short antisense compound targeted to nucleotides 587-603 comprises a nucleotide sequence selected from SEQ ID NO 258, 259, 260, 261, 262, or 263. In certain such embodiments, a short antisense compound targeted to nucleotides 587-603 of SEQ ID NO: 3 is selected from Isis NO. 405219, 405220, 405221, 405222, 405223, or 405224.

In certain embodiments, a target region is nucleotides 974-1014 of SEQ ID NO: 3. In certain embodiments, a short antisense compound is targeted to nucleotides 974-1014 of SEQ ID NO: 3. In certain such embodiments, a short antisense compound targeted to nucleotides 974-1014 comprises a nucleotide sequence selected from SEQ ID NO 267, 268, 269, 270, 271, 272, or 274. In certain such embodiments, a short antisense compound targeted to nucleotides 974-1014 of SEQ ID NO: 3 is selected from Isis NO. 379696, 405226, 405227, 405228, 405229, 405230, 379697, or 405231.

In certain embodiments, a target region is nucleotides 998-1014 of SEQ ID NO: 3. In certain embodiments, a short antisense compound is targeted to nucleotides 998-1014 of SEQ ID NO: 3. In certain such embodiments, a short antisense compound targeted to nucleotides 998-1014 comprises a nucleotide sequence selected from SEQ ID NO 268, 269, 270, 271, 272, or 274. In certain such embodiments, a short antisense compound targeted to nucleotides 998-1014 of SEQ ID NO: 3 is selected from Isis NO. 405226, 405227, 405228, 405229, 405230, 379697, or 405231.

In certain embodiments, a target region is nucleotides 1091-1170 of SEQ ID NO: 3. In certain embodiments, a short antisense compound is targeted to nucleotides 1091-1170 of SEQ ID NO: 3. In certain such embodiments, a short antisense compound targeted to nucleotides 1091-1170 comprises a nucleotide sequence selected from SEQ ID NO 275, 276, 277, 278, 279, 280, 281, 283, 284, 285, 286, or 287. In certain such embodiments, a short antisense compound targeted to nucleotides 1091-1170 of SEQ ID NO: 3 is selected from Isis NO. 379698, 405232, 405233, 405234, 405235, 388626, 379699, 382677, 405236, 405237, 405238, 379700, or 405239.

In certain embodiments, a target region is nucleotides 1091-1104 of SEQ ID NO: 3. In certain embodiments, a short antisense compound is targeted to nucleotides 1091-1104 of SEQ ID NO: 3. In certain such embodiments, a short antisense compound targeted to nucleotides 1091-1104 comprises a nucleotide sequence selected from SEQ ID NO 275, 276, or 277. In certain such embodiments, an short antisense compound targeted to nucleotides 1091-1104 of SEQ ID NO: 3 is selected from Isis NO. 379698, 405232, or 405233.

In certain embodiments, a target region is nucleotides 1130-1144 of SEQ ID NO: 3. In certain embodiments, a short antisense compound is targeted to nucleotides 1130-1144 of SEQ ID NO: 3. In certain such embodiments, a short antisense compound targeted to nucleotides 1130-1144 comprises a nucleotide sequence selected from SEQ ID NO 278, 279, 280, 281, or 283. In certain such embodiments, a short antisense compound targeted to nucleotides 1130-1144 of SEQ ID NO: 3 is selected from Isis NO. 405234, 405235, 388626, 379699, 382677, or 405236.

In certain embodiments, a target region is nucleotides 1157-1170 of SEQ ID NO: 3. In certain embodiments, a short antisense compound is targeted to nucleotides 1157-1170 of SEQ ID NO: 3. In certain such embodiments, a short antisense compound targeted to nucleotides 1157-1170 comprises a nucleotide sequence selected from SEQ ID NO 284, 285, or 287. In certain such embodiments, a short antisense compound targeted to nucleotides 1157-1170 of SEQ ID NO: 3 is selected from Isis NO. 405237, 405238, 379700, or 405239.

In certain embodiments, a target region is nucleotides 1542-1556 of SEQ ID NO: 3. In certain embodiments, a short antisense compound is targeted to nucleotides 1542-1556 of SEQ ID NO: 3. In certain such embodiments, a short antisense compound targeted to nucleotides 1542-1556 comprises a nucleotide sequence selected from SEQ ID NO 289, 290, 291, 292, or 293. In certain such embodiments, a short antisense compound targeted to nucleotides 1542-1556 of SEQ ID NO: 3 is selected from Isis NO. 405240, 405241, 405242, 388629, 379702, or 382678.

In certain embodiments, a target region is nucleotides 1976-1991 of SEQ ID NO: 3. In certain embodiments, a short antisense compound is targeted to nucleotides 1976-1991 of SEQ ID NO: 3. In certain such embodiments, a short antisense compound targeted to nucleotides 1976-1991 comprises a nucleotide sequence selected from SEQ ID NO 296, 297, 298, 299, or 300. In certain such embodiments, a short antisense compound targeted to nucleotides 1976-1991 of SEQ ID NO: 3 is selected from Isis NO. 405243, 405244, 405245, 405246, or 405247.

In certain embodiments, short antisense compounds targeted to an SGLT2 nucleic acid are 8 to 16, preferably 9 to 15, more preferably 9 to 14, more preferably 10 to 14 nucleotides in length. In certain embodiments, short antisense compounds targeted to an SGLT2 nucleic acid are 9 to 14 nucleotides in length. In certain embodiments, short antisense compounds targeted to an SGLT2 nucleic acid are 10 to 14 nucleotides in length. In certain embodiments, such short antisense compounds are short antisense oligonucleotides.

In certain embodiments, short antisense compounds targeted to an SGLT2 nucleic acid are short gapmers. In certain such embodiments, short gapmers targeted to an SGLT2 nucleic acid comprise at least one high affinity modification in one or more wings of the compound. In certain embodiments, short antisense compounds targeted to an SGLT2 nucleic acid comprise 1 to 3 high-affinity modifications in each wing. In certain such embodiments, the nucleosides or nucleotides of the wing comprise a 2' modification. In certain such embodiments, the monomers of the wing are BNA's. In certain such embodiments, the monomers of the wing are selected from α-L-Methyleneoxy (4'-$CH_2$—O-2') BNA, β-D-Methyleneoxy (4'-$CH_2$—O-2') BNA, Ethyleneoxy (4'-$(CH_2)_2$—O-2') BNA, Aminooxy (4'-$CH_2$—O—N(R)-2') BNA and Oxyamino (4'-$CH_2$—N(R)—O-2') BNA. In certain embodiments, the monomers of a wing comprise a substituent at the 2' position selected from allyl, amino, azido, thio, O-allyl, O—$C_1$-$C_{10}$ alkyl, —$OCF_3$, O—$(CH_2)_2$—O—$CH_3$, 2'-O$(CH_2)_2$S$CH_3$, O—$(CH_2)_2$—O—N($R_m$)($R_n$), and O—$CH_2$—C(=O)—N($R_m$)($R_n$), where each $R_m$ and $R_n$ is, independently, H or substituted or unsubstituted $C_1$-$C_{10}$ alkyl. In certain embodiments, the monomers of a wing are 2'MOE nucleotides.

In certain embodiments, short antisense compounds targeted to an SGLT2 nucleic acid comprise a gap between the 5' wing and the 3' wing. In certain embodiments the gap comprises five, six, seven, eight, nine, ten, eleven, twelve, thirteen, or fourteen monomers. In certain embodiments, the monomers of the gap are unmodified deoxyribonucleotides. In certain embodiments, the monomers of the gap are unmodified ribonucleotides. In certain embodiments, gap modifications (if any) gap result in an antisense compound that, when bound to its target nucleic acid, supports cleavage by an RNase, including, but not limited to, RNase H.

In certain embodiments, short antisense compounds targeted to an SGLT2 nucleic acid have uniform monomeric linkages. In certain such embodiments, those linkages are all phosphorothioate linkages. In certain embodiments, the linkages are all phosphodiester linkages. In certain embodiments, short antisense compounds targeted to an SGLT2 nucleic acid have mixed backbones.

In certain embodiments, short antisense compounds targeted to an SGLT2 nucleic acid are 8 monomers in length. In certain embodiments, short antisense compounds targeted to an SGLT2 nucleic acid are 9 monomers in length. In certain embodiments, short antisense compounds targeted to an SGLT2 nucleic acid are 10 monomers in length. In certain embodiments, short antisense compounds targeted to an SGLT2 nucleic acid are 11 monomers in length. In certain embodiments, short antisense compounds targeted to an SGLT2 nucleic acid are monomers in length. In certain embodiments, short antisense compounds targeted to an SGLT2 nucleic acid are 13 monomers in length. In certain embodiments, short antisense compounds targeted to an SGLT2 nucleic acid are 14 monomers in length. In certain embodiments, short antisense compounds targeted to an SGLT2 nucleic acid are 15 monomers in length. In certain embodiments, short antisense compounds targeted to an SGLT2 nucleic acid are 16 monomers in length. In certain embodiments, short antisense compounds targeted to an SGLT2 nucleic acid comprise 9 to 15 monomers. In certain embodiments, short antisense compounds targeted to an SGLT2 nucleic acid comprise 10 to 15 monomers. In certain embodiments, short antisense compounds targeted to an SGLT2 nucleic acid comprise 12 to 14 monomers. In certain embodiments, short antisense compounds targeted to an SGLT2 nucleic acid comprise 12 to 14 nucleotides or nucleosides.

In certain embodiments, the invention provides methods of modulating expression of SGLT2. In certain embodiments, such methods comprise use of one or more short antisense compound targeted to an SGLT2 nucleic acid, wherein the short antisense compound targeted to an SGLT2 nucleic acid is from about 8 to about 16, preferably 9 to 15, more preferably 9 to 14, more preferably 10 to 14 monomers (i.e. from about 8 to about 16 linked monomers). One of ordinary skill in the art will appreciate that this comprehends methods of modulating expression of SGLT2 using one or more short antisense compounds targeted to an SGLT2 nucleic acid of 8, 9, 10, 11, 12, 13, 14, 15 or 16 monomers.

In certain embodiments, methods of modulating SGLT2 comprise use of a short antisense compound targeted to an SGLT2 nucleic acid that is 8 monomers in length. In certain embodiments, methods of modulating SGLT2 comprise use of a short antisense compound targeted to an SGLT2 nucleic acid that is 9 monomers in length. In certain embodiments, methods of modulating SGLT2 comprise use of a short antisense compound targeted to an SGLT2 nucleic acid that is 10 monomers in length. In certain embodiments, methods of modulating SGLT2 comprise use of a short antisense compound targeted to an SGLT2 nucleic acid that is 11 monomers in length. In certain embodiments, methods of modulating SGLT2 comprise use of a short antisense compound targeted to an SGLT2 nucleic acid that is 12 monomers in length. In certain embodiments, methods of modulating SGLT2 comprise use of a short antisense compound targeted to an SGLT2 nucleic acid that is 13 monomers in length. In certain embodiments, methods of modulating SGLT2 comprise use of a short antisense compound targeted to an SGLT2 nucleic acid that is 14 monomers in length. In certain embodiments, methods of modulating SGLT2 comprise use of a short antisense compound targeted to an SGLT2 nucleic acid that is 15 monomers in length. In certain embodiments, methods of modulating SGLT2 comprise use of a short antisense compound targeted to an SGLT2 nucleic acid that is 16 monomers in length.

In certain embodiments, methods of modulating expression of SGLT2 comprise use of a short antisense compound targeted to an SGLT2 nucleic acid comprising 9 to 15 monomers. In certain embodiments, methods of modulating expression of SGLT2 comprise use of a short antisense compound targeted to an SGLT2 nucleic acid comprising 10 to 15 monomers. In certain embodiments, methods of modulating expression of SGLT2 comprise use of a short antisense compound targeted to an SGLT2 nucleic acid comprising 12 to 14 monomers. In certain embodiments, methods of modulating expression of SGLT2 comprise use of a short antisense compound targeted to an SGLT2 nucleic acid comprising 12 or 14 nucleotides or nucleosides.

3. PCSK9

In individuals with autosomal dominant hypercholesterolemia (ADH), elevated LDL-C levels have been linked to mutations in the genes encoding LDL-receptor (LDL-R), apolipoprotein B (apoB), or proprotein convertase subtilisin/kexin type 9 (PCSK9) (Abifadel et al., Nat. Genet., 2003, 34:154-156). PCSK9 was identified as a third locus associated with ADH when gain-of-function mutations in PCSK9 were found to be linked to elevated LDL-C levels. ApoB participates in the intracellular assembly and secretion of triglyceride-rich lipoproteins and is a ligand for the LDL-R. PCSK9 is proposed to reduce LDL-R expression levels in the liver. Reduced LDL-R expression results in reduced hepatic uptake of circulating ApoB-containing lipoproteins, which in turn leads to elevated cholesterol.

Definitions

"PCSK9" is the gene product or protein of which expression is to be modulated by administration of a short antisense compound.

"PCSK9 nucleic acid" means any nucleic acid encoding PCSK9. For example, in certain embodiments, a PCSK9 nucleic acid includes, without limitation, a DNA sequence encoding PCSK9, an RNA sequence transcribed from DNA encoding PCSK9, and an mRNA sequence encoding PCSK9.

"PCSK9 mRNA" means an mRNA encoding PCSK9.

PCSK9 Therapeutic Indications

In certain embodiments, the invention provides methods of modulating the expression of PCSK9 in an individual comprising administering a short antisense compound targeted to a PCSK9 nucleic acid. In certain embodiments, the invention provides methods of treating an individual comprising administering one or more pharmaceutical compositions of the present invention. In certain embodiments, the individual has hypercholesterolemia, mixed dyslipidemia, atherosclerosis, a risk of developing atherosclerosis, coronary heart disease, a history of coronary heart disease, early onset coronary heart disease, one or more risk factors for coronary heart disease, type II diabetes, type II diabetes with dyslipidemia, dyslipidemia, hypertriglyceridemia, hyperlipidemia, hyperfattyacidemia, hepatic steatosis, non-alcoholic steatohepatitis, or non-alcoholic fatty liver disease.

Guidelines for lipid-lowering therapy were established in 2001 by Adult Treatment Panel III (ATP III) of the National Cholesterol Education Program (NCEP), and updated in 2004 (Grundy et al., Circulation, 2004, 110, 227-239). The guidelines include obtaining a complete lipoprotein profile, typically after a 9 to 12 hour fast, for determination of LDL-C, total cholesterol, and HDL-C levels. According to the most recently established guidelines, LDL-C levels of 130-159 mg/dL, 160-189 mg/dL, and greater than or equal to 190 mg/dL are considered borderline high, high, and very high, respectively. Total cholesterol levels of 200-239 and greater than or equal to 240 mg/dL are considered borderline high and high, respectively. HDL-C levels of less than 40 mg/dL are considered low.

In certain embodiments, the individual has been identified as in need of lipid-lowering therapy. In certain such embodiments, the individual has been identified as in need of lipid-lowering therapy according to the guidelines established in 2001 by Adult Treatment Panel III (ATP III) of the National Cholesterol Education Program (NCEP), and updated in 2004 (Grundy et al., Circulation, 2004, 110, 227-239). In certain such embodiments, the individual in need of lipid-lowering therapy has LDL-C above 190 mg/dL. In certain such embodiments, the individual in need of lipid-lowering therapy has LDL-C above 160 mg/dL. In certain such embodiments, the individual in need of lipid-lowering therapy has LDL-C above 130 mg/dL. In certain such embodiments the individual in need of lipid-lowering therapy has LDL-C above 100 mg/dL. In certain such embodiments the individual in need of lipid-lowering therapy should maintain LDL-C below 160 mg/dL. In certain such embodiments the individual in need of lipid-lowering therapy should maintain LDL-C below 130 mg/dL. In certain such embodiments the individual in need of lipid-lowering therapy should maintain LDL-C below 100 mg/dL. In certain such embodiments the individual should maintain LDL-C below 70 mg/dL.

In certain embodiments the invention provides methods for reducing ApoB in an individual. In certain embodiments the invention provides methods for reducing ApoB-containing lipoprotein in an individual. In certain embodiments the invention provides methods for reducing LDL-C in an individual. In certain embodiments the invention provides methods for reducing VLDL-C in an individual. In certain embodiments the invention provides methods for reducing IDL-C in an individual. In certain embodiments the invention provides methods for reducing non-HDL-C in an individual. In certain embodiments the invention provides methods for reducing Lp(a) in an individual. In certain embodiments the invention provides methods for reducing serum triglyceride in an individual. In certain embodiments the invention provides methods for reducing liver triglyceride in an individual. In certain embodiments the invention provides methods for reducing Ox-LDL-C in an individual. In certain embodiments the invention provides methods for reducing small LDL particles in an individual. In certain embodiments the invention provides methods for reducing small VLDL particles in an individual. In certain embodiments the invention provides methods for reducing phospholipids in an individual. In certain embodiments the invention provides methods for reducing oxidized phospholipids in an individual.

In certain embodiments, the methods provided by the present invention do not lower HDL-C. In certain embodiments, the methods provided by the present invention do not result in accumulation of lipids in the liver.

In certain embodiments a pharmaceutical composition comprising a short antisense compound targeted to a PCSK9 nucleic acid is for use in therapy. In certain embodiments, the therapy is the reduction of LDL-C, ApoB, VLDL-C, IDL-C, non-HDL-C, Lp(a), serum triglyceride, liver triglyceride, Ox-LDL-C, small LDL particles, small VLDL, phospholipids, or oxidized phospholipids in an individual. In certain embodiments, the therapy is the treatment of hypercholesterolemia, mixed dyslipidemia, atherosclerosis, a risk of developing atherosclerosis, coronary heart disease, a history of coronary heart disease, early onset coronary heart disease, one or more risk factors for coronary heart disease, type II diabetes, type II diabetes with dyslipidemia, dyslipidemia, hypertriglyceridemia, hyperlipidemia, hyperfattyacidemia, hepatic steatosis, non-alcoholic steatohepatitis, or non-alcoholic fatty liver disease. In additional embodiments, the therapy is the reduction of CHD risk. In certain the therapy is prevention of atherosclerosis. In certain embodiments, the therapy is the prevention of coronary heart disease.

In certain embodiments a pharmaceutical composition comprising a short antisense compound targeted to a PCSK9 nucleic acid is used for the preparation of a medicament for reducing LDL-C, ApoB, VLDL-C, IDL-C, non-HDL-C, Lp(a), serum triglyceride, liver triglyceride, Ox-LDL-C, small LDL particles, small VLDL, phospholipids, or oxidized phospholipids in an individual. In certain embodiments pharmaceutical composition comprising a short antisense compound targeted to PCKS9 is used for the preparation of a medicament for reducing coronary heart disease risk. In certain embodiments a short antisense compound targeted to a PCSK9 nucleic acid is used for the preparation of a medicament for the treatment of hypercholesterolemia, mixed dyslipidemia, atherosclerosis, a risk of developing atherosclerosis, coronary heart disease, a history of coronary heart disease, early onset coronary heart disease, one or more risk factors for coronary heart disease, type II diabetes, type II diabetes with dyslipidemia, dyslipidemia, hypertriglyceridemia, hyperlipidemia, hyperfattyacidemia, hepatic steatosis, non-alcoholic steatohepatitis, or non-alcoholic fatty liver disease.

PCSK9 Combination Therapies

In certain embodiments, one or more pharmaceutical compositions of the present invention are co-administered with one or more other pharmaceutical agents. In certain embodiments, such one or more other pharmaceutical agents are designed to treat the same disease or condition as the one or more pharmaceutical compositions of the present invention. In certain embodiments, such one or more other pharmaceutical agents are designed to treat a different disease or condition as the one or more pharmaceutical compositions of the present invention. In certain embodiments, such one or more other pharmaceutical agents are designed to treat an undesired effect of one or more pharmaceutical compositions of the present invention. In certain embodiments, one or more pharmaceutical compositions of the present invention are co-administered with another pharmaceutical agent to treat an undesired effect of that other pharmaceutical agent. In certain embodiments, one or more pharmaceutical compositions of the present invention and one or more other pharmaceutical agents are administered at the same time. In certain embodiments, one or more pharmaceutical compositions of the present invention and one or more other pharmaceutical agents are administered at different times. In certain embodiments, one or more pharmaceutical compositions of the present invention and one or more other pharmaceutical agents are prepared together in a single formulation. In certain embodiments, one or more pharmaceutical compositions of the present invention and one or more other pharmaceutical agents are prepared separately.

In certain embodiments, pharmaceutical agents that may be co-administered with a pharmaceutical composition of the present invention include lipid-lowering agents. In certain such embodiments, pharmaceutical agents that may be co-administered with a pharmaceutical composition of the present invention include, but are not limited to atorvastatin, simvastatin, rosuvastatin, and ezetimibe. In certain such embodiments, the lipid-lowering agent is administered prior to administration of a pharmaceutical composition of the present invention. In certain such embodiments, the lipid-lowering agent is administered following administration of a pharmaceutical composition of the present invention. In certain such embodiments the lipid-lowering agent is administered at the same time as a pharmaceutical composition of the present invention. In certain such embodiments the dose of a co-administered lipid-lowering agent is the same as the dose that would be administered if the lipid-lowering agent was administered alone. In certain such embodiments the dose of a co-administered lipid-lowering agent is lower than the dose that would be administered if the lipid-lowering agent was administered alone. In certain such embodiments the dose of a co-administered lipid-lowering agent is greater than the dose that would be administered if the lipid-lowering agent was administered alone.

In certain embodiments, a co-administered lipid-lowering agent is a HMG-CoA reductase inhibitor. In certain such embodiments the HMG-CoA reductase inhibitor is a statin. In certain such embodiments the statin is selected from atorvastatin, simvastatin, pravastatin, fluvastatin, and rosuvastatin.

In certain embodiments, a co-administered lipid-lowering agent is a cholesterol absorption inhibitor. In certain such embodiments, cholesterol absorption inhibitor is ezetimibe.

In certain embodiments, a co-administered lipid-lowering agent is a co-formulated HMG-CoA reductase inhibitor and cholesterol absorption inhibitor. In certain such embodiments the co-formulated lipid-lowering agent is ezetimibe/simvastatin.

In certain embodiments, a co-administered lipid-lowering agent is a microsomal triglyceride transfer protein inhibitor (MTP inhibitor).

In certain embodiments, a co-administered lipid-lowering agent is an oligonucleotide targeted to an ApoB nucleic acid.

In certain embodiments, a co-administered pharmaceutical agent is a bile acid sequestrant. In certain such embodiments, the bile acid sequestrant is selected from cholestyramine, colestipol, and colesevelam.

In certain embodiments, a co-administered pharmaceutical agent is a nicotinic acid. In certain such embodiments, the nicotinic acid is selected from immediate release nicotinic acid, extended release nicotinic acid, and sustained release nicotinic acid.

In certain embodiments, a co-administered pharmaceutical agent is a fibric acid. In certain such embodiments, a fibric acid is selected from gemfibrozil, fenofibrate, clofibrate, bezafibrate, and ciprofibrate.

Further examples of pharmaceutical agents that may be co-administered with a pharmaceutical composition of the present invention include, but are not limited to, corticosteroids, including but not limited to prednisone; immunoglobulins, including, but not limited to intravenous immunoglobulin (IVIg); analgesics (e.g., acetaminophen); anti-inflammatory agents, including, but not limited to non-steroidal anti-inflammatory drugs (e.g., ibuprofen, COX-1 inhibitors, and COX-2, inhibitors); salicylates; antibiotics; antivirals; antifungal agents; antidiabetic agents (e.g., biguanides, glucosidase inhibitors, insulins, sulfonylureas, and thiazolidenediones); adrenergic modifiers; diuretics; hormones (e.g., anabolic steroids, androgen, estrogen, calcitonin, progestin, somatostan, and thyroid hormones); immunomodulators; muscle relaxants; antihistamines; osteoporosis agents (e.g., biphosphonates, calcitonin, and estrogens); prostaglandins, antineoplastic agents; psychotherapeutic agents; sedatives; poison oak or poison sumac products; antibodies; and vaccines.

In certain embodiments, the pharmaceutical compositions of the present invention may be administered in conjuction with a lipid-lowering therapy. In certain such embodiments, a lipid-lowering therapy is therapeutic lifestyle change. In certain such embodiments, a lipid-lowering therapy is LDL apheresis.

Certain Short Antisense Compounds Targeted to a PCSK9 Nucleic Acid

In certain embodiments, short antisense compounds are targeted to a PCSK9 nucleic acid having the sequence of GENBANK® Accession No. NM_174936.2, incorporated herein as SEQ ID NO: 4. In certain such embodiments, a short antisense compound targeted to SEQ ID NO: 4 is at least 90% complementary to SEQ ID NO: 4. In certain such embodiments, a short antisense compound targeted to SEQ ID NO: 4 is at least 95% complementary to SEQ ID NO: 4. In certain such embodiments, a short antisense compound targeted to SEQ ID NO: 4 is 100% complementary to SEQ ID NO: 4. In certain embodiments, a short antisense compound targeted to SEQ ID NO: 4 comprises a nucleotide sequence selected from the nucleotide sequences set forth in Table 6 or Table 7.

The nucleotide sequence set forth in each SEQ ID NO in Tables 6 and 7 is independent of any modification to a sugar moiety, an internucleoside linkage, or a nucleobase. As such, short antisense compounds defined by a SEQ ID NO may comprise, independently, one or more modifications to a sugar moiety, an internucleoside linkage, or a nucleobase. Short antisense compounds described by Isis Number (Isis NO.) indicate a combination of nucleobase sequence and one or more modifications to a sugar moiety, an internucleoside linkage, or a nucleobase.

Tables 6 and 7 illustrate examples of short antisense compounds targeted to SEQ ID NO: 4. Table 6 illustrates short antisense compounds that are 100% complementary to SEQ ID NO: 4. Table 7 illustrates short antisense compounds that have one or two mismatches with respect to SEQ ID NO: 4. The column labeled 'gapmer motif' indicates the wing-gap-wing motif of each short antisense compounds. The gap segment comprises 2'-deoxynucleotides and each nucleotide of each wing segment comprises a 2'-modified sugar. The particular 2'-modified sugar is also indicated in the 'gapmer motif' column. For example, '2-10-2 MOE' means a 2-10-2 gapmer motif, where a gap segment of ten 2'-deoxynucleotides is flanked by wing segments of two nucleotides, where the nucleotides of the wing segments are 2'-MOE nucleotides. Internucleoside linkages are phosphorothioate. The short antisense compounds comprise 5-methylcytidine in place of unmodified cytosine, unless "unmodified cytosine" is listed in the gapmer motif column, in which case the indicated cytosines are unmodified cytosines. For example, "5-mC in gap only" indicates that the gap segment has 5-methylcytosines, while the wing segments have unmodified cytosines.

TABLE 6

Short Antisense Compounds targeted to SEQ ID NO: 4

| ISIS NO. | 5' Target Site | 3' Target Site | Sequence (5'-3') | Gapmer Motif | SEQ ID NO |
|---|---|---|---|---|---|
| 400297 | 695 | 708 | ATGGGGCAACTTCA | 2-10-2 MOE | 329 |
| 400298 | 696 | 709 | CATGGGGCAACTTC | 2-10-2 MOE | 330 |
| 400299 | 697 | 710 | ACATGGGGCAACTT | 2-10-2 MOE | 331 |
| 400300 | 742 | 755 | GGGATGCTCTGGGC | 2-10-2 MOE | 332 |
| 400301 | 757 | 770 | CGCTCCAGGTTCCA | 2-10-2 MOE | 333 |
| 400302 | 828 | 841 | GATACACCTCCACC | 2-10-2 MOE | 334 |
| 400303 | 829 | 842 | AGATACACCTCCAC | 2-10-2 MOE | 335 |
| 400304 | 830 | 843 | GAGATACACCTCCA | 2-10-2 MOE | 336 |
| 400305 | 937 | 950 | GCCTGTCTGTGGAA | 2-10-2 MOE | 337 |
| 400306 | 952 | 965 | CTGTCACACTTGCT | 2-10-2 MOE | 338 |
| 400307 | 988 | 1001 | CGGCCGCTGACCAC | 2-10-2 MOE | 339 |
| 400308 | 989 | 1002 | CCGGCCGCTGACCA | 2-10-2 MOE | 340 |

TABLE 6-continued

Short Antisense Compounds targeted to SEQ ID NO: 4

| ISIS NO. | 5' Target Site | 3' Target Site | Sequence (5'-3') | Gapmer Motif | SEQ ID NO |
|---|---|---|---|---|---|
| 400309 | 990 | 1003 | CCCGGCCGCTGACC | 2-10-2 MOE | 341 |
| 400310 | 991 | 1004 | TCCCGGCCGCTGAC | 2-10-2 MOE | 342 |
| 400311 | 992 | 1005 | ATCCCGGCCGCTGA | 2-10-2 MOE | 343 |
| 400312 | 993 | 1006 | CATCCCGGCCGCTG | 2-10-2 MOE | 344 |
| 400313 | 994 | 1007 | GCATCCCGGCCGCT | 2-10-2 MOE | 345 |
| 400314 | 1057 | 1070 | GTGCCCTTCCCTTG | 2-10-2 MOE | 346 |
| 400315 | 1075 | 1088 | ATGAGGGTGCCGCT | 2-10-2 MOE | 347 |
| 400316 | 1076 | 1089 | TATGAGGGTGCCGC | 2-10-2 MOE | 348 |
| 400317 | 1077 | 1090 | CTATGAGGGTGCCG | 2-10-2 MOE | 349 |
| 400318 | 1078 | 1091 | CCTATGAGGGTGCC | 2-10-2 MOE | 350 |
| 400319 | 1093 | 1106 | CGAATAAACTCCAG | 2-10-2 MOE | 351 |
| 400320 | 1094 | 1107 | CCGAATAAACTCCA | 2-10-2 MOE | 352 |
| 400321 | 1095 | 1108 | TCCGAATAAACTCC | 2-10-2 MOE | 353 |
| 400322 | 1096 | 1109 | TTCCGAATAAACTC | 2-10-2 MOE | 354 |
| 400323 | 1147 | 1160 | GCCAGGGGCAGCAG | 2-10-2 MOE | 355 |
| 400324 | 1255 | 1268 | GAGTAGAGGCAGGC | 2-10-2 MOE | 356 |
| 400325 | 1334 | 1347 | CCCCAAAGTCCCCA | 2-10-2 MOE | 357 |
| 400326 | 1335 | 1348 | TCCCCAAAGTCCCC | 2-10-2 MOE | 358 |
| 400327 | 1336 | 1349 | GTCCCCAAAGTCCC | 2-10-2 MOE | 359 |
| 400328 | 1453 | 1466 | ACGTGGGCAGCAGC | 2-10-2 MOE | 360 |
| 400329 | 1454 | 1467 | CACGTGGGCAGCAG | 2-10-2 MOE | 361 |
| 400330 | 1455 | 1468 | CCACGTGGGCAGCA | 2-10-2 MOE | 362 |
| 400331 | 1456 | 1469 | GCCACGTGGGCAGC | 2-10-2 MOE | 363 |
| 400332 | 1569 | 1582 | CAGGGAACCAGGCC | 2-10-2 MOE | 364 |
| 400333 | 1570 | 1583 | TCAGGGAACCAGGC | 2-10-2 MOE | 365 |
| 400334 | 1571 | 1584 | CTCAGGGAACCAGG | 2-10-2 MOE | 366 |
| 400335 | 1572 | 1585 | CCTCAGGGAACCAG | 2-10-2 MOE | 367 |
| 400336 | 1573 | 1586 | TCCTCAGGGAACCA | 2-10-2 MOE | 368 |
| 400337 | 1574 | 1587 | GTCCTCAGGGAACC | 2-10-2 MOE | 369 |
| 400338 | 1575 | 1588 | GGTCCTCAGGGAAC | 2-10-2 MOE | 370 |
| 400339 | 1576 | 1589 | TGGTCCTCAGGGAA | 2-10-2 MOE | 371 |
| 400340 | 1577 | 1590 | CTGGTCCTCAGGGA | 2-10-2 MOE | 372 |
| 400341 | 1578 | 1591 | GCTGGTCCTCAGGG | 2-10-2 MOE | 373 |
| 400342 | 1621 | 1634 | GTGCTGGGGGGCAG | 2-10-2 MOE | 374 |
| 400343 | 1622 | 1635 | GGTGCTGGGGGGCA | 2-10-2 MOE | 375 |
| 400344 | 1623 | 1636 | GGGTGCTGGGGGGC | 2-10-2 MOE | 376 |
| 400345 | 1624 | 1637 | TGGGTGCTGGGGGG | 2-10-2 MOE | 377 |

TABLE 6-continued

Short Antisense Compounds targeted to SEQ ID NO: 4

| ISIS NO. | 5' Target Site | 3' Target Site | Sequence (5'-3') | Gapmer Motif | SEQ ID NO |
|---|---|---|---|---|---|
| 400346 | 1738 | 1751 | GAGCAGCTCAGCAG | 2-10-2 MOE | 378 |
| 400347 | 1739 | 1752 | GGAGCAGCTCAGCA | 2-10-2 MOE | 379 |
| 400348 | 1740 | 1753 | TGGAGCAGCTCAGC | 2-10-2 MOE | 380 |
| 400349 | 1741 | 1754 | CTGGAGCAGCTCAG | 2-10-2 MOE | 381 |
| 400350 | 1834 | 1847 | CCCTCACCCCCAAA | 2-10-2 MOE | 382 |
| 400351 | 1835 | 1848 | ACCCTCACCCCCAA | 2-10-2 MOE | 383 |
| 400352 | 1836 | 1849 | CACCCTCACCCCCA | 2-10-2 MOE | 384 |
| 400353 | 1837 | 1850 | ACACCCTCACCCCC | 2-10-2 MOE | 385 |
| 400354 | 1838 | 1851 | GACACCCTCACCCC | 2-10-2 MOE | 386 |
| 400355 | 1839 | 1852 | AGACACCCTCACCC | 2-10-2 MOE | 387 |
| 400356 | 1840 | 1853 | TAGACACCCTCACC | 2-10-2 MOE | 388 |
| 400357 | 2083 | 2096 | TGGCAGCAGGAAGC | 2-10-2 MOE | 389 |
| 400358 | 2084 | 2097 | ATGGCAGCAGGAAG | 2-10-2 MOE | 390 |
| 400359 | 2085 | 2098 | CATGGCAGCAGGAA | 2-10-2 MOE | 391 |
| 400360 | 2086 | 2099 | GCATGGCAGCAGGA | 2-10-2 MOE | 392 |
| 400361 | 2316 | 2329 | GGCAGCAGATGGCA | 2-10-2 MOE | 393 |
| 400362 | 2317 | 2330 | CGGCAGCAGATGGC | 2-10-2 MOE | 394 |
| 400363 | 2318 | 2331 | CCGGCAGCAGATGG | 2-10-2 MOE | 395 |
| 400364 | 2319 | 2332 | TCCGGCAGCAGATG | 2-10-2 MOE | 396 |
| 400365 | 2320 | 2333 | CTCCGGCAGCAGAT | 2-10-2 MOE | 397 |
| 400366 | 2321 | 2334 | GCTCCGGCAGCAGA | 2-10-2 MOE | 398 |
| 400367 | 2322 | 2335 | GGCTCCGGCAGCAG | 2-10-2 MOE | 399 |
| 400368 | 2323 | 2336 | CGGCTCCGGCAGCA | 2-10-2 MOE | 400 |
| 400369 | 2324 | 2337 | CCGGCTCCGGCAGC | 2-10-2 MOE | 401 |
| 400370 | 2325 | 2338 | GCCGGCTCCGGCAG | 2-10-2 MOE | 402 |
| 400371 | 3543 | 3556 | AGTTACAAAAGCAA | 2-10-2 MOE | 403 |
| 403739 | 988 | 1001 | CGGCCGCTGACCAC | 2-10-2 (6'S)-6'-methyl-Methyleneoxy BNA | 339 |
| 403740 | 1455 | 1468 | CCACGTGGGCAGCA | 2-10-2 (6'S)-6'-methyl-Methyleneoxy BNA | 362 |

TABLE 7

Short antisense compounds targeted to SEQ ID NO: 4 and having 1 or 2 mismatches

| ISIS NO. | 5' Target Site | 3' Target Site | Sequence (5'-3') | Gapmer Motif | SEQ ID NO |
|---|---|---|---|---|---|
| 400323 | 349 | 362 | GCCAGGGGCAGCAG | 2-10-2 MOE | 355 |
| 400370 | 679 | 692 | GCCGGCTCCGGCAG | 2-10-2 MOE | 402 |
| 400361 | 1860 | 1873 | GGCAGCAGATGGCA | 2-10-2 MOE | 393 |
| 400323 | 1873 | 1886 | GCCAGGGGCAGCAG | 2-10-2 MOE | 355 |
| 400310 | 2257 | 2270 | TCCCGGCCGCTGAC | 2-10-2 MOE | 342 |
| 400361 | 2653 | 2666 | GGCAGCAGATGGCA | 2-10-2 MOE | 393 |
| 400350 | 2811 | 2824 | CCCTCACCCCCAAA | 2-10-2 MOE | 382 |
| 400351 | 2812 | 2825 | ACCCTCACCCCCAA | 2-10-2 MOE | 383 |
| 400352 | 2813 | 2826 | CACCCTCACCCCCA | 2-10-2 MOE | 384 |
| 400353 | 2814 | 2827 | ACACCCTCACCCCC | 2-10-2 MOE | 385 |
| 400334 | 2966 | 2979 | CTCAGGGAACCAGG | 2-10-2 MOE | 366 |
| 400332 | 3379 | 3392 | CAGGGAACCAGGCC | 2-10-2 MOE | 364 |
| 400340 | 3448 | 3461 | CTGGTCCTCAGGGA | 2-10-2 MOE | 372 |
| 400341 | 3449 | 3462 | GCTGGTCCTCAGGG | 2-10-2 MOE | 373 |

In certain embodiments, a target region is nucleotides 695-710 of SEQ ID NO: 4. In certain such embodiments, short antisense compounds targeted to nucleotides 695-710 of SEQ ID NO: 4 comprise a nucleotide sequence selected from SEQ ID NO: 329, 330, or 331. In certain such embodiments, a short antisense compound targeted to nucleotides 695-710 of SEQ ID NO: 4 is selected from Isis NO. 400297, 400298, or 400299.

In certain embodiments, a target region is nucleotides 742-770 of SEQ ID NO: 4. In certain such embodiments, a short antisense compound targeted to nucleotides 742-770 of SEQ ID NO: 4 comprises a nucleotide sequence selected from SEQ ID NO 332 or 333. In certain such embodiments, a short antisense compound targeted to nucleotides 742-770 of SEQ ID NO: 4 is selected from Isis NO. 400300 or 400301.

In certain embodiments, a target region is nucleotides 828-843 of SEQ ID NO: 4. In certain such embodiments, a short antisense compound targeted to nucleotides 828-843 of SEQ ID NO: 4 comprises a nucleotide sequence selected from SEQ ID NO 334, 335, or 336. In certain such embodiments, a short antisense compound targeted to nucleotides 828-843 of SEQ ID NO: 4 is selected from ISIS No. 400302, 400303, or 400304.

In certain embodiments, a target region is nucleotides 937-1007 of SEQ ID NO: 4. In certain such embodiments, a short antisense compound targeted to nucleotides 937-1007 of SEQ ID NO: 4 comprises a nucleotide sequence selected from SEQ ID NO 337, 338, 339, 340, 341, 342, 343, 344, or 345. In certain such embodiments, a short antisense compound targeted to nucleotides 937-1007 of SEQ ID NO: 4 is selected from Isis NO. 400305, 400306, 400307, 400308, 400309, 400310, 400311, 400312, 400313, or 403739.

In certain embodiments, a target region is nucleotides 937-965 of SEQ ID NO: 4. In certain such embodiments, a short antisense compound targeted to nucleotides 937-965 of SEQ ID NO: 4 comprises a nucleotide sequence selected from SEQ ID NO 337 or 338. In certain such embodiments, a short antisense compound targeted to nucleotides 937-965 of SEQ ID NO: 4 is selected from Isis NO. 400305 or 400306.

In certain embodiments, a target region is nucleotides 988-1007 of SEQ ID NO: 4. In certain such embodiments, a short antisense compound targeted to nucleotides 988-1007 of SEQ ID NO: 4 comprises a nucleotide sequence selected from SEQ ID NO 339, 340, 341, 342, 343, 344, or 345. In certain such embodiments, a short antisense compound targeted to nucleotides 937-1007 of SEQ ID NO: 4 is selected from Isis NO. 400307, 400308, 400309, 400310, 400311, 400312, 4003313, or 403739.

In certain embodiments, a target region is nucleotides 1057-1160 of SEQ ID NO: 4. In certain such embodiments, a short antisense compound targeted to nucleotides 1057-1160 of SEQ ID NO: 4 comprises a nucleotide sequence selected from SEQ ID NO 346, 347, 348, 349, 350, 351, 352, 353, 354, or 355. In certain such embodiments, a short antisense compound targeted to nucleotides 1057-1160 of SEQ ID NO: 4 is selected from ISIS NO. 400314, 400315, 400316, 400317, 400318, 400319, 400320, 400321, 400322, or 400323.

In certain embodiments, a target region is nucleotides 1057-1109 of SEQ ID NO: 4. In certain such embodiments, a short antisense compound targeted to nucleotides 1057-1109 of SEQ ID NO: 4 comprises a nucleotide sequence selected from SEQ ID NO 346, 347, 348, 349, 350, 351, 352, 353, or 354. In certain such embodiments, a short antisense compound targeted to nucleotides 1057-1109 of SEQ ID NO: 4 is selected from ISIS NO. 400314, 400315, 400316, 400317, 400318, 400319, 400320, 400321, or 400322.

In certain embodiments, a target region is nucleotides 1057-1091 of SEQ ID NO: 4. In certain such embodiments, a short antisense compound targeted to nucleotides 1057-1091 of SEQ ID NO: 4 comprises a nucleotide sequence selected from SEQ ID NO 346, 347, 348, 349, or 350. In certain such embodiments, a short antisense compound targeted to nucleotides 1057-1091 of SEQ ID NO: 4 is selected from ISIS NO. 400314, 400315, 400316, 400317, or 400318.

In certain embodiments, a target region is nucleotides 1093-1109 of SEQ ID NO: 4. In certain such embodiments, a short antisense compound targeted to nucleotides 1093-1109 of SEQ ID NO: 4 comprises a nucleotide sequence selected from SEQ ID NO 351, 352, 353, or 354. In certain such embodiments, a short antisense compound targeted to nucleotides 1057-1109 of SEQ ID NO: 4 is selected from ISIS NO. 400319, 400320, 400321, or 400322.

In certain embodiments, a target region is nucleotides 1334-1349 of SEQ ID NO: 4. In certain such embodiments, a short antisense compound targeted to nucleotides 1334-1349 of SEQ ID NO: 4 comprises a nucleotide sequence selected from SEQ ID NO 357, 358, or 359. In certain such embodiments, a short antisense compound targeted to nucleotides 1334-1349 of SEQ ID NO: 4 is selected from ISIS NO 400325, 400326, or 400327.

In certain embodiments, a target region is nucleotides 1453-1469 of SEQ ID NO: 4. In certain such embodiments, a short antisense compound targeted to nucleotides 1453-1469 of SEQ ID NO: 4 comprises a nucleotide sequence selected from SEQ ID NO 360, 361, 362, or 363. In certain such embodiments, a short antisense compound targeted to nucleotides 1453-1469 of SEQ ID NO: 4 is selected from ISIS NO 400328, 400329, 400330, 400331, or 403-470.

In certain embodiments, a target region is nucleotides 1569-1591 of SEQ ID NO: 4. In certain such embodiments, a short antisense compound targeted to nucleotides 1569-1591 of SEQ ID NO: 4 comprises a nucleotide sequence selected from SEQ ID NO 364, 365, 366, 367, 368, 369, 370, 371, 372, or 373. In certain such embodiments, a short antisense compound targeted to nucleotides 1569-1591 of SEQ ID NO: 4 is selected from ISIS NO 400332, 400333, 400334, 400335, 400336, 400337, 400338, 400339, 400340, or 400341.

In certain embodiments, a target region is nucleotides 1621-1637 of SEQ ID NO: 4. In certain such embodiments, a short antisense compound targeted to nucleotides 1621-1637 of SEQ ID NO: 4 comprises a nucleotide sequence selected from SEQ ID NO 374, 375, 376, or 377. In certain such embodiments, a short antisense compound targeted to nucleotides 1621-1637 of SEQ ID NO: 4 is selected from ISIS NO 400342, 400343, 400344, or 400345.

In certain embodiments, a target region is nucleotides 1738-1754 of SEQ ID NO: 4. In certain such embodiments, a short antisense compound targeted to nucleotides 1738-1754 of SEQ ID NO: 4 comprises a nucleotide sequence selected from SEQ ID NO 378, 379, 380, or 381. In certain such embodiments, a short antisense compound targeted to nucleotides 1738-1754 of SEQ ID NO: 4 is selected from ISIS NO 400346, 400347, 400348, or 400349.

In certain embodiments, a target region is nucleotides 1834-1853 of SEQ ID NO: 4. In certain such embodiments, a short antisense compound targeted to nucleotides 1834-1853 of SEQ ID NO: 4 comprises a nucleotide sequence selected from SEQ ID NO 382, 383, 384, 385, 386, 387, or 388. In certain embodiments, a short antisense compound targeted to nucleotides 1834-1853 of SEQ ID NO: 4 is selected from ISIS NO 400350, 400351, 400352, 400353, 400354, 400355, or 400356.

In certain embodiments, a target region is nucleotides 2083-2099 of SEQ ID NO: 4. In certain such embodiments, a short antisense compound targeted to nucleotides 2083-2099 of SEQ ID NO: 4 comprises a nucleotide sequence selected from SEQ ID NO 389, 390, 391, or 392. In certain such embodiments, a short antisense compound targeted to nucleotides 2083-2099 of SEQ ID NO: 4 is selected from ISIS NO 400357, 400358, 400359, or 400360.

In certain embodiments, a target region is nucleotides 2316-2338 of SEQ ID NO: 4. In certain such embodiments, a short antisense compound targeted to nucleotides 2316-2338 of SEQ ID NO: 4 comprises a nucleotide sequence selected from SEQ ID NO 393, 394, 395, 396, 397, 398, 399, 400, 401, or 402. In certain such embodiments, a short antisense compound targeted to nucleotides 2316-2338 of SEQ ID NO: 4 is selected from ISIS NO 400361, 400362, 400363, 400364, 400365, 400366, 400367, 400368, 400369, or 400370.

In certain embodiments, short antisense compounds targeted to a PCSK9 nucleic acid are 8 to 16, preferably 9 to 15, more preferably 9 to 14, more preferably 10 to 14 nucleotides in length. In certain embodiments, short antisense compounds targeted to a PCSK9 nucleic acid are 9 to 14 nucleotides in length. In certain embodiments, short antisense compounds targeted to a PCSK9 nucleic acid are 10 to 14 nucleotides in length. In certain embodiments, such short antisense compounds are short antisense oligonucleotides.

In certain embodiments, short antisense compounds targeted to a PCSK9 nucleic acid are short gapmers. In certain such embodiments, short gapmers targeted to a PCSK9 nucleic acid comprise at least one high affinity modification in one or more wings of the compound. In certain embodiments, short antisense compounds targeted to a PCSK9 nucleic acid comprise 1 to 3 high-affinity modifications in each wing. In certain such embodiments, the nucleosides or nucleotides of the wing comprise a 2' modification. In certain such embodiments, the monomers of the wing are BNA's. In certain such embodiments, the monomers of the wing are selected from α-L-Methyleneoxy (4'-CH$_2$—O-2') BNA, β-D-Methyleneoxy (4'-CH$_2$—O-2') BNA, Ethyleneoxy (4'-(CH$_2$)$_2$—O-2') BNA, Aminooxy (4'-CH$_2$—O—N(R)-2') BNA and Oxyamino (4'-CH$_2$—N(R)-0-2') BNA. In certain embodiments, the monomers of a wing comprise a substituent at the 2' position selected from allyl, amino, azido, thio, O-allyl, O—C$_1$-C$_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), and O—CH$_2$—C(=O)—N(R$_m$)(R$_n$), where each R$_m$ and R$_n$ is, independently, H or substituted or unsubstituted C$_1$-C$_{10}$ alkyl. In certain embodiments, the monomers of a wing are 2'MOE nucleotides.

In certain embodiments, short antisense compounds targeted to a PCSK9 nucleic acid comprise a gap between the 5' wing and the 3' wing. In certain embodiments the gap comprises five, six, seven, eight, nine, ten, eleven, twelve, thirteen, or fourteen monomers. In certain embodiments, the monomers of the gap are unmodified deoxyribonucleotides. In certain embodiments, the monomers of the gap are unmodified ribonucleotides. In certain embodiments, gap modifications (if any) gap result in an antisense compound that, when bound to its target nucleic acid, supports cleavage by an RNase, including, but not limited to, RNase H.

In certain embodiments, short antisense compounds targeting a PCSK9 nucleic acid may have any one or more properties or characteristics of the short antisense compounds generally described herein. In certain embodiments, short antisense compounds targeting a PCSK9 nucleic acid have a motif (wing-deoxy gap-wing) selected from 1-12-1, 1-1-10-2, 2-10-1-1, 3-10-3, 2-10-3, 2-10-2, 1-10-1, 1-10-2, 3-8-3, 2-8-2, 1-8-1, 3-6-3 or 1-6-1, more preferably 1-10-1, 2-10-2, 3-10-3, and 1-9-2.

In certain embodiments, short antisense compounds targeted to a PCSK9 nucleic acid have uniform monomeric linkages. In certain such embodiments, those linkages are all phosphorothioate linkages. In certain embodiments, the linkages are all phosphodiester linkages. In certain embodiments, short antisense compounds targeted to a PCSK9 nucleic acid have mixed backbones.

In certain embodiments, short antisense compounds targeted to a PCSK9 nucleic acid are 8 monomers in length. In certain embodiments, short antisense compounds targeted to a PCSK9 nucleic acid are 9 monomers in length. In certain embodiments, short antisense compounds targeted to a PCSK9 nucleic acid are 10 monomers in length. In certain embodiments, short antisense compounds targeted to a PCSK9 nucleic acid are 11 monomers in length. In certain embodiments, short antisense compounds targeted to a PCSK9 nucleic acid are monomers in length. In certain embodiments, short antisense compounds targeted to a PCSK9 nucleic acid are 13 monomers in length. In certain embodiments, short antisense compounds targeted to a PCSK9 nucleic acid are 14 monomers in length. In certain embodiments, short antisense compounds targeted to a PCSK9 nucleic acid are 15 monomers in length. In certain embodiments, short antisense compounds targeted to a PCSK9 nucleic acid are 16 monomers in length. In certain embodiments, short antisense compounds targeted to a PCSK9 nucleic acid comprise 9 to 15 monomers. In certain embodiments, short antisense compounds targeted to a PCSK9 nucleic acid comprise 10 to 15 monomers. In certain embodiments, short antisense compounds targeted to a PCSK9 nucleic acid comprise 12 to 14 monomers. In certain embodiments, short antisense compounds targeted to a PCSK9 nucleic acid comprise 12 to 14 nucleotides or nucleosides.

In certain embodiments, the invention provides methods of modulating expression of PCSK9. In certain embodiments, such methods comprise use of one or more short antisense compound targeted to a PCSK9 nucleic acid, wherein the short antisense compound targeted to a PCSK9 nucleic acid is from about 8 to about 16, preferably 9 to 15, more preferably 9 to 14, more preferably 10 to 14 monomers (i.e. from about 8 to about 16 linked monomers). One of ordinary skill in the art will appreciate that this comprehends methods of modulating expression of PCSK9 using one or more short antisense compounds targeted to a PCSK9 nucleic acid of 8, 9, 10, 11, 12, 13, 14, 15 or 16 monomers.

In certain embodiments, methods of modulating PCSK9 comprise use of a short antisense compound targeted to a PCSK9 nucleic acid that is 8 monomers in length. In certain embodiments, methods of modulating PCSK9 comprise use of a short antisense compound targeted to a PCSK9 nucleic acid that is 9 monomers in length. In certain embodiments, methods of modulating PCSK9 comprise use of a short antisense compound targeted to a PCSK9 nucleic acid that is 10 monomers in length. In certain embodiments, methods of modulating PCSK9 comprise use of a short antisense compound targeted to a PCSK9 nucleic acid that is 11 monomers in length. In certain embodiments, methods of modulating PCSK9 comprise use of a short antisense compound targeted to a PCSK9 nucleic acid that is 12 monomers in length. In certain embodiments, methods of modulating PCSK9 comprise use of a short antisense compound targeted to a PCSK9 nucleic acid that is 13 monomers in length. In certain embodiments, methods of modulating PCSK9 comprise use of a short antisense compound targeted to a PCSK9 nucleic acid that is 14 monomers in length. In certain embodiments, methods of modulating PCSK9 comprise use of a short antisense compound targeted to a PCSK9 nucleic acid that is 15 monomers in length. In certain embodiments, methods of modulating PCSK9 comprise use of a short antisense compound targeted to a PCSK9 nucleic acid that is 16 monomers in length.

In certain embodiments, methods of modulating expression of PCSK9 comprise use of a short antisense compound targeted to a PCSK9 nucleic acid comprising 9 to 15 monomers. In certain embodiments, methods of modulating expression of PCSK9 comprise use of a short antisense compound targeted to a PCSK9 nucleic acid comprising 10 to 15 monomers. In certain embodiments, methods of modulating expression of PCSK9 comprise use of a short antisense compound targeted to a PCSK9 nucleic acid comprising 12 to 14 monomers. In certain embodiments, methods of modulating expression of PCSK9 comprise use of a short antisense compound targeted to a PCSK9 nucleic acid comprising 12 or 14 nucleotides or nucleosides.

4. Superoxide Dismutase 1 Enzyme (SOD1)

The enzymes known as the superoxide dismutases (SODs) provide defense against oxidative damage of biomolecules by catalyzing the dismutation of superoxide to hydrogen peroxide ($H_2O_2$) (Fridovich, Annu. Rev. Biochem., 1995, 64, 97-112). Two major classes of superoxide dismutases exist. One consists of a group of enzymes with active sites containing copper and zinc while the other class has either manganese or iron at the active site (Fridovich, Annu. Rev. Biochem., 1995, 64, 97-112).

Mutations in the superoxide dismutase 1 gene are associated with a dominantly-inherited form of amyotrophic lateral sclerosis (ALS, also known as Lou Gehrig's disease) a disorder characterized by a selective degeneration of upper and lower motor neurons (Cleveland and Liu, Nat. Med., 2000, 6, 1320-1321). The deleterious effects of various mutations on superoxide dismutase 1 are most likely mediated through a gain of toxic function rather than a loss of superoxide dismutase 1 activity, as the complete absence of superoxide dismutase 1 in mice neither diminishes life nor provokes overt disease (Al-Chalabi and Leigh, Curr. Opin. Neurol., 2000, 13, 397-405; Alisky and Davidson, Hum. Gene Ther., 2000, 11, 2315-2329).

Over 100 mutations of the human SOD1 gene have been identified, and altogether account for approximately 20% of familial amyotrophic lateral sclerosis (ALS) cases. Some mutations, such as the A4V mutation most commonly found in the United States, are highly lethal and result in survival only nine months from the onset of disease symptoms. Other mutations of SOD1 manifest in a slower disease course.

Definitions

"SOD1" means the gene product or protein of which expression is to be modulated by administration of a short antisense compound.

"SOD1 nucleic acid" means any nucleic acid encoding SOD1. For example, in certain embodiments, a SOD1 nucleic acid includes, without limitations, a DNA sequence encoding SOD1, an RNA sequence transcribed from DNA encoding SOD1, and an mRNA sequence encoding SOD1.

"SOD1 mRNA" means an mRNA encoding SOD1.

SOD1 Therapeutic Indications

It has been discovered that antisense inhibition of superoxide dismutase 1 (SOD1) in an animal model of familial ALS reduces both SOD1 mRNA and protein, and further results in a slowing of disease progression and, importantly, increased survival time. Accordingly, in certain embodiments, the invention provides methods for the slowing of disease progression in an individual suffering from familial ALS by administering to such an individual a short antisense compound targeted to an SOD1 nucleic acid. In certain such embodiments, a short antisense compound targeted to SOD1 are delivered directly to the cerebrospinal fluid of the individual. In certain such embodiments, methods further comprise increasing survival time of an individual suffering from familial ALS. Slowing of disease progression is indicated by an improvement in one or more indicators of ALS disease progression, including, without limitation, the revised ALS functional rating scale, pulmonary function tests, and muscle strength measurements.

SOD1 Combination Therapies

In certain embodiments, one or more pharmaceutical compositions comprising a short antisense compound targeted to an SOD1 nucleic acid is co-administered with one or more other pharmaceutical agents. In certain embodiments, such one or more other pharmaceutical agents are designed to treat the same disease or condition as the one or more pharmaceutical compositions of the present invention. In certain embodiments, such one or more other pharmaceutical agents are designed to treat a different disease or condition as the one or more pharmaceutical compositions of the present invention. In certain embodiments, such one or more other pharmaceutical agents are designed to treat an undesired effect of one or more pharmaceutical compositions of the present invention. In certain embodiments, one or more pharmaceutical compositions of the present invention are co-administered with another pharmaceutical agent to treat an undesired effect of that other pharmaceutical agent. In certain embodiments, one or more pharmaceutical compositions of the present invention and one or more other pharmaceutical agents are administered at the same time. In certain embodiments, one or more pharmaceutical compositions of the present invention and one or more other pharmaceutical agents are administered at different times. In certain embodiments, one or more pharmaceutical compositions of the present invention and one or more other pharmaceutical agents are prepared together in a single formulation. In certain embodiments, one or more pharmaceutical compositions of the present invention and one or more other pharmaceutical agents are prepared separately.

In certain embodiments, a co-administered pharmaceutical agent is a nicotinic acid. In certain such embodiments, the nicotinic acid is selected from immediate release nicotinic acid, extended release nicotinic acid, and sustained release nicotinic acid.

In certain embodiments, a co-administered pharmaceutical agent is a fibric acid. In certain such embodiments, a fibric acid is selected from gemfibrozil, fenofibrate, clofibrate, bezafibrate, and ciprofibrate.

Further examples of pharmaceutical agents that may be co-administered with a pharmaceutical composition comprising a short antisense compound targeted to SOD1 include, but are not limited to, corticosteroids, including but not limited to prednisone; immunoglobulins, including, but not limited to intravenous immunoglobulin (IVIg); analgesics (e.g., acetaminophen); anti-inflammatory agents, including, but not limited to non-steroidal anti-inflammatory drugs (e.g., ibuprofen, COX-1 inhibitors, and COX-2, inhibitors); salicylates; antibiotics; antivirals; antifungal agents; antidiabetic agents (e.g., biguanides, glucosidase inhibitors, insulins, sulfonylureas, and thiazolidenediones); adrenergic modifiers; diuretics; hormones (e.g., anabolic steroids, androgen, estrogen, calcitonin, progestin, somatostan, and thyroid hormones); immunomodulators; muscle relaxants; antihistamines; osteoporosis agents (e.g., biphosphonates, calcitonin, and estrogens); prostaglandins, antineoplastic agents; psychotherapeutic agents; sedatives; poison oak or poison sumac products; antibodies; and vaccines.

Certain Short Antisense Compounds Targeted to a SOD1 Nucleic Acid

In certain embodiments, short antisense compounds are targeted to a SOD1 nucleic acid having the sequence of GENBANK® Accession No. NM_X02317.1, incorporated herein as SEQ ID NO: 5. In certain such embodiments, a short antisense compound targeted to SEQ ID NO: 5 is at least 90% complementary to SEQ ID NO: 5. In certain such embodiments, a short antisense compound targeted to SEQ ID NO: 5 is at least 95% complementary to SEQ ID NO: 5. In certain such embodiments, a short antisense compound targeted to SEQ ID NO: 5 is 100% complementary to SEQ ID NO: 5. In certain embodiments, a short antisense compound targeted to SEQ ID NO: 5 comprises a nucleotide sequence selected from the nucleotide sequences set forth in Table 8 or Table 9.

The nucleotide sequence set forth in each SEQ ID NO in Tables 8 and 9 is independent of any modification to a sugar moiety, an internucleoside linkage, or a nucleobase. As such, short antisense compounds defined by a SEQ ID NO may comprise, independently, one or more modifications to a sugar moiety, an internucleoside linkage, or a nucleobase. Short antisense compounds described by Isis Number (Isis NO.) indicate a combination of nucleobase sequence and one or more modifications to a sugar moiety, an internucleoside linkage, or a nucleobase.

Table 8 illustrates examples of short antisense compounds targeted to SEQ ID NO: 5. Table 8 illustrates short antisense compounds that are 100% complementary to SEQ ID NO: 5. The column labeled 'gapmer motif' indicates the wing-gap-wing motif of each short antisense compounds. The gap segment comprises 2'-deoxynucleotides and each nucleotide of each wing segment comprises a 2'-modified sugar. The particular 2'-modified sugar is also indicated in the 'gapmer motif' column. For example, '2-10-2 MOE' means a 2-10-2 gapmer motif, where a gap segment of ten 2'-deoxynucleotides is flanked by wing segments of two nucleotides, where the nucleotides of the wing segments are 2'-MOE nucleotides. Internucleoside linkages are phosphorothioate. The short antisense compounds comprise 5-methylcytidine in place of unmodified cytosine, unless "unmodified cytosine" is listed in the gapmer motif column, in which case the indicated cytosines are unmodified cytosines. For example, "5-mC in gap only" indicates that the gap segment has 5-methylcytosines, while the wing segments have unmodified cytosines.

In certain embodiments, short antisense compounds targeting a SOD1 nucleic acid may have any one or more properties or characteristics of the short antisense compounds generally described herein. In certain embodiments, short antisense compounds targeting a SOD1 nucleic acid have a motif (wing-deoxy gap-wing) selected from 1-12-1, 1-1-10-2, 2-10-1-1, 3-10-3, 2-10-3, 2-10-2, 1-10-1, 1-10-2, 3-8-3, 2-8-2, 1-8-1, 3-6-3 or 1-6-1, more preferably 1-10-1, 2-10-2, 3-10-3, and 1-9-2.

TABLE 8

Short Antisense Compounds targeted to SEQ ID NO: 5

| ISIS NO. | 5' Target Site | 3' Target Site | Sequence (5'-3') | Gapmer Motif | SEQ ID NO |
|---|---|---|---|---|---|
| 387541 | 85 | 100 | GTCGCCCTTCAGCACG | 3-10-3 MOE | 406 |
| 387540 | 86 | 99 | TCGCCCTTCAGCAC | 2-10-2 MOE | 407 |
| 387539 | 87 | 98 | CGCCCTTCAGCA | 1-10-1 MOE | 408 |

In certain embodiments, a target region is nucleotides 85-100 of SEQ ID NO: 5. In certain such embodiments, short antisense compounds targeted to nucleotides 85-100 of SEQ ID NO: 5 comprise a nucleotide sequence selected from SEQ ID NO: 406, 407, or 408. In certain such embodiments, a short antisense compound targeted to nucleotides 85-100 of SEQ ID NO: 5 is selected from Isis No. 387541, 387540, or 387539.

In certain embodiments, short antisense compounds targeted to a SOD1 nucleic acid are 8 to 16, preferably 9 to 15, more preferably 9 to 14, more preferably 10 to 14 nucleotides in length. In certain embodiments, short antisense compounds targeted to a SOD1 nucleic acid are 9 to 14 nucleotides in length. In certain embodiments, short antisense compounds targeted to a SOD1 nucleic acid are 10 to 14 nucleotides in length. In certain embodiments, such short antisense compounds are short antisense oligonucleotides.

In certain embodiments, short antisense compounds targeted to a SOD1 nucleic acid are short gapmers. In certain such embodiments, short gapmers targeted to a SOD1 nucleic acid comprise at least one high affinity modification in one or more wings of the compound. In certain embodiments, short antisense compounds targeted to a SOD1 nucleic acid comprise 1 to 3 high-affinity modifications in each wing. In certain such embodiments, the nucleosides or nucleotides of the wing comprise a 2' modification. In certain such embodiments, the monomers of the wing are BNA's. In certain such embodiments, the monomers of the wing are selected from α-L-Methyleneoxy (4'-CH$_2$—O-2') BNA, β-D-Methyleneoxy (4'-CH$_2$—O-2') BNA, Ethyleneoxy (4'-(CH$_2$)$_2$—O-2') BNA, Aminooxy (4'-CH$_2$—O—N(R)-2') BNA and Oxyamino (4'-CH$_2$—N(R)-0-2') BNA. In certain embodiments, the monomers of a wing comprise a substituent at the 2' position selected from allyl, amino, azido, thio, O-allyl, O—C$_1$-C$_{10}$ alkyl, —OCF$_3$, O—(CH$_2$)$_2$—O—CH$_3$, 2'-O $(CH_2)_2SCH_3$, $O-(CH_2)_2-O-N(R_m)(R_n)$, and $O-CH_2C(=O)-N(R_m)(R_n)$, where each $R_m$ and $R_n$ is, independently, H or substituted or unsubstituted $C_1$-$C_{10}$ alkyl. In certain embodiments, the monomers of a wing are 2'MOE nucleotides.

In certain embodiments, short antisense compounds targeted to a SOD1 nucleic acid comprise a gap between the 5' wing and the 3' wing. In certain embodiments the gap comprises five, six, seven, eight, nine, ten, eleven, twelve, thirteen, or fourteen monomers. In certain embodiments, the monomers of the gap are unmodified deoxyribonucleotides. In certain embodiments, the monomers of the gap are unmodified ribonucleotides. In certain embodiments, gap modifications (if any) gap result in an antisense compound that, when bound to its target nucleic acid, supports cleavage by an RNase, including, but not limited to, RNase H.

In certain embodiments, short antisense compounds targeted to a SOD1 nucleic acid have uniform monomeric linkages. In certain such embodiments, those linkages are all phosphorothioate linkages. In certain embodiments, the linkages are all phosphodiester linkages. In certain embodiments, short antisense compounds targeted to a SOD1 nucleic acid have mixed backbones.

In certain embodiments, short antisense compounds targeted to a SOD1 nucleic acid are 8 monomers in length. In certain embodiments, short antisense compounds targeted to a SOD1 nucleic acid are 9 monomers in length. In certain embodiments, short antisense compounds targeted to a SOD1 nucleic acid are 10 monomers in length. In certain embodiments, short antisense compounds targeted to a SOD1 nucleic acid are 11 monomers in length. In certain embodiments, short antisense compounds targeted to a SOD1 nucleic acid are monomers in length. In certain embodiments, short antisense compounds targeted to a SOD1 nucleic acid are 13 monomers in length. In certain embodiments, short antisense compounds targeted to a SOD1 nucleic acid are 14 monomers in length. In certain embodiments, short antisense compounds targeted to a SOD1 nucleic acid are 15 monomers in length. In certain embodiments, short antisense compounds targeted to a SOD1 nucleic acid are 16 monomers in length. In certain embodiments, short antisense compounds targeted to a SOD1 nucleic acid comprise 9 to 15 monomers. In certain embodiments, short antisense compounds targeted to a SOD1 nucleic acid comprise 10 to 15 monomers. In certain embodiments, short antisense compounds targeted to a SOD1 nucleic acid comprise 12 to 14 monomers. In certain embodiments, short antisense compounds targeted to a SOD1 nucleic acid comprise 12 to 14 nucleotides or nucleosides.

In certain embodiments, the invention provides methods of modulating expression of SOD1. In certain embodiments, such methods comprise use of one or more short antisense compound targeted to a SOD1 nucleic acid, wherein the short antisense compound targeted to a SOD1 nucleic acid is from about 8 to about 16, preferably 9 to 15, more preferably 9 to 14, more preferably 10 to 14 monomers (i.e. from about 8 to about 16 linked monomers). One of ordinary skill in the art will appreciate that this comprehends methods of modulating expression of SOD1 using one or more short antisense compounds targeted to a SOD1 nucleic acid of 8, 9, 10, 11, 12, 13, 14, 15 or 16 monomers.

In certain embodiments, methods of modulating SOD1 comprise use of a short antisense compound targeted to a SOD1 nucleic acid that is 8 monomers in length. In certain embodiments, methods of modulating SOD1 comprise use of a short antisense compound targeted to a SOD1 nucleic acid that is 9 monomers in length. In certain embodiments, methods of modulating SOD1 comprise use of a short antisense compound targeted to a SOD1 nucleic acid that is 10 monomers in length. In certain embodiments, methods of modulating SOD1 comprise use of a short antisense compound targeted to a SOD1 nucleic acid that is 11 monomers in length. In certain embodiments, methods of modulating SOD1 comprise use of a short antisense compound targeted to a SOD1 nucleic acid that is 12 monomers in length. In certain embodiments, methods of modulating SOD1 comprise use of a short antisense compound targeted to a SOD1 nucleic acid that is 13 monomers in length. In certain embodiments, methods of modulating SOD1 comprise use of a short antisense compound targeted to a SOD1 nucleic acid that is 14 monomers in length. In certain embodiments, methods of modulating SOD1 comprise use of a short antisense compound targeted to a SOD1 nucleic acid that is 15 monomers in length. In certain embodiments, methods of modulating SOD1 comprise use of a short antisense compound targeted to a SOD1 nucleic acid that is 16 monomers in length.

In certain embodiments, methods of modulating expression of SOD1 comprise use of a short antisense compound targeted to a SOD1 nucleic acid comprising 9 to 15 monomers. In certain embodiments, methods of modulating expression of SOD1 comprise use of a short antisense compound targeted to a SOD1 nucleic acid comprising 10 to 15 monomers. In certain embodiments, methods of modulating expression of SOD1 comprise use of a short antisense compound targeted to a SOD1 nucleic acid comprising 12 to 14 monomers. In certain embodiments, methods of modulating expression of SOD1 comprise use of a short antisense compound targeted to a SOD1 nucleic acid comprising 12 or 14 nucleotides or nucleosides.

5. CRP

CRP (also known as C-reactive protein and PTX1) is an essential human acute-phase reactant produced in the liver in response to a variety of inflammatory cytokines. The protein, first identified in 1930, is highly conserved and considered to be an early indicator of infectious or inflammatory conditions. Plasma CRP levels increase 1,000-fold in response to infection, ischemia, trauma, burns, and inflammatory conditions. In clinical trials where patients receive lipid-lowering therapy, such as statin therapy, it has been demonstrated that patients having reductions in both LDL-C and CRP have a reduced risk of future coronary events relative to patients experiencing only reductions in LDL-C.

Definitions

"CRP" means the gene product or protein of which expression is to be modulated by a short antisense compound.

"CRP nucleic acid" means any nucleic acid encoding CRP. For example, in certain embodiments, a CRP nucleic acid includes, without limitations, a DNA sequence encoding CRP, an RNA sequence transcribed from DNA encoding CRP, and an mRNA sequence encoding CRP.

"CRP mRNA" means an mRNA encoding CRP.

CRP Therapeutic Indications

In certain embodiments, the invention provides methods of modulating CRP expression in an individual comprising administering to the individual a short antisense compound targeted to a CRP nucleic acid. In certain embodiments, the invention provides methods of treating an individual comprising administering one or more pharmaceutical compositions comprising a short antisense compound targeted to a CRP nucleic acid. In certain embodiments, the individual has hypercholesterolemia, non-familial hypercholesterolemia, familial hypercholesterolemia, heterozygous familial hypercholesterolemia, homozygous familial hypercholesterolemia, mixed dyslipidemia, atherosclerosis, a risk of developing atherosclerosis, coronary heart disease, a history of coronary heart disease, early onset coronary heart disease, one or more risk factors for coronary heart disease. In certain embodiments, the individual has acute coronary syndrome, vascular injury, arterial occlusion, unstable angina, post peripheral vascular disease, post myocardial infarction (MI), thrombosis, deep vein thrombus, end-stage renal disease (ESRD), chronic renal failure, complement activation, congestive heart failure, or systemic vasculitis. In certain embodiments, the individual has had a stroke.

In certain embodiments, the individual has undergone a procedure selected from elective stent placement, angioplasty, post percutaneous transluminal angioplasty (PTCA), cardiac transplantation, renal dialysis or cardiopulmonary bypass.

In certain embodiments, the individual has an inflammatory disease. In certain such embodiments, the inflammatory disease is selected from inflammatory bowel disease, ulcerative colitis, rheumatoid arthritis, or osteoarthritis.

Guidelines for lipid-lowering therapy were established in 2001 by Adult Treatment Panel III (ATP III) of the National Cholesterol Education Program (NCEP), and updated in 2004 (Grundy et al., Circulation, 2004, 110, 227-239). The guidelines include obtaining a complete lipoprotein profile, typically after a 9 to 12 hour fast, for determination of LDL-C, total cholesterol, and HDL-C levels. According to the most recently established guidelines, LDL-C levels of 130-159 mg/dL, 160-189 mg/dL, and greater than or equal to 190 mg/dL are considered borderline high, high, and very high, respectively. Total cholesterol levels of 200-239 and greater than or equal to 240 mg/dL are considered borderline high and high, respectively. HDL-C levels of less than 40 mg/dL are considered low.

In certain embodiments, the individual has been identified as in need of lipid-lowering therapy. In certain such embodiments, the individual has been identified as in need of lipid-lowering therapy according to the guidelines established in 2001 by Adult Treatment Panel III (ATP III) of the National Cholesterol Education Program (NCEP), and updated in 2004 (Grundy et al., Circulation, 2004, 110, 227-239). In certain such embodiments, the individual in need of lipid-lowering therapy has LDL-C above 190 mg/dL. In certain such embodiments, the individual in need of lipid-lowering therapy has LDL-C above 160 mg/dL. In certain such embodiments, the individual in need of lipid-lowering therapy has LDL-C above 130 mg/dL. In certain such embodiments the individual in need of lipid-lowering therapy has LDL-C above 100 mg/dL. In certain such embodiments the individual in need of lipid-lowering therapy should maintain LDL-C below 160 mg/dL. In certain such embodiments the individual in need of lipid-lowering therapy should maintain LDL-C below 130 mg/dL. In certain such embodiments the individual in need of lipid-lowering therapy should maintain LDL-C below 100 mg/dL. In certain such embodiments the individual should maintain LDL-C below 70 mg/dL.

In certain embodiments the invention provides methods for reducing CRP in an individual. In certain such embodiments, the reduction in CRP is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, and at least 100%.

In certain embodiments, the methods provided by the present invention do not lower HDL-C. In certain embodiments, the methods provided by the present invention do not result in accumulation of lipids in the liver. In certain embodiments, the methods provided by the present invention do not cause hepatic steatosis.

In certain embodiments, the invention provides methods for lowering CRP concentration in a subject while reducing side effects associated with treatment. In certain such embodiments, a side effect is liver toxicity. In certain such embodiments, a side effect is abnormal liver function. In certain such embodiments, a side effect is elevated alanine aminotransferase (ALT). In certain such embodiments, a side effect is elevated aspartate aminotransferase (AST).

In certain embodiments, the invention provides methods for lowering CRP concentration in a subject who is not reaching target LDL-C levels as a result of lipid-lowering therapy. In certain such embodiments, a short antisense compound targeted to a CRP nucleic acid is the only pharmaceutical agent administered to the subject. In certain such embodiments, the subject has not complied with recommended lipid-lowering therapy. In certain such embodiments, a pharmaceutical composition of the invention is co-administered with an additional different lipid-lowering therapy. In certain such embodiments, an additional lipid-lowering therapy is LDL-apheresis. In certain such embodiments, an additional lipid-lowering therapy is a statin. In certain such embodiments, an additional lipid-lowering therapy is ezetimibe.

In certain embodiments, the invention provides methods for lowering CRP concentration in a statin-intolerant subject. In certain such embodiments, the subject has creatine kinase concentration increases as a result of statin administration. In certain such embodiments, the subject has liver function abnormalities as a result of statin administration. In certain such embodiments the subject has muscle aches as a result of statin administration. In certain such embodiments the subject has central nervous system side effects as a result of statin administration. In certain embodiments, the subject has not complied with recommended statin administration.

In certain embodiments, the invention provides methods for reducing coronary heart disease risk in a subject. In certain embodiments the invention provides methods for slowing the progression of atherosclerosis in a subject. In certain such embodiments the invention provides methods for stopping the progression of atherosclerosis in a subject. In certain such embodiments the invention provides methods for reducing the size and/or prevalence of atherosclerotic plaques in a subject. In certain embodiments the methods provided reduce a subject's risk of developing atherosclerosis.

In certain embodiments the methods provided improve the cardiovascular outcome in a subject. In certain such embodiments improved cardiovascular outcome is the reduction of the risk of developing coronary heart disease. In certain such embodiments, improved cardiovascular outcome is a reduction in the occurrence of one or more major cardiovascular events, which include, but are not limited to, death, myocardial infarction, reinfarction, stroke, cardiogenic shock, pulmonary edema, cardiac arrest, and atrial dysrhythmia. In certain such embodiments, the improved cardiovascular outcome is evidenced by improved carotid intimal media thickness. In certain such embodiments, improved carotid intimal media thickness is a decrease in thickness. In certain such embodiments, improved carotid intimal media thickness is a prevention an increase of intimal media thickness.

In certain embodiments a pharmaceutical composition comprising a short antisense compound targeted to a CRP nucleic acid is for use in therapy. In certain embodiments, the therapy is the reduction of CRP in an individual. In certain embodiments, the therapy is the treatment of hypercholesterolemia, non-familial hypercholesterolemia, familial hypercholesterolemia, heterozygous familial hypercholesterolemia, homozygous familial hypercholesterolemia, mixed dyslipidemia, atherosclerosis, a risk of developing atherosclerosis, coronary heart disease, a history of coronary heart disease, or early onset coronary heart disease. In additional embodiments, the therapy is the reduction of CHD risk. In certain the therapy is prevention of atherosclerosis. In certain embodiments, the therapy is the prevention of coronary heart disease. In certain embodiments, the therapy is the treatment of acute coronary syndrome, chronic renal failure, vascular injury, arterial occlusion, atherothrombosis, unstable angina, post peripheral vascular disease, post myocardial infarction (MI), thrombosis, deep vein thrombus, end-stage renal disease (ESRD), complement activation, congestive heart failure, or systemic vasculitis. In certain embodiments the therapy is the treatment of an individual who has undergone a procedure selected from elective stent placement, angioplasty, post percutaneous transluminal angioplasty (PTCA), cardiac transplantation, renal dialysis or cardiopulmonary bypass. In certain embodiments, the therapy is the treatment of an inflammatory disorder.

In certain embodiments a pharmaceutical composition comprising a short antisense compound targeted to a CRP nucleic acid is used for the preparation of a medicament for reducing CRP in an individual. In certain embodiments pharmaceutical composition comprising a short antisense compound targeted to a CRP nucleic acid is used for the preparation of a medicament for reducing coronary heart disease risk. In certain embodiments a short antisense compound targeted to a CRP nucleic acid is used for the preparation of a medicament for the treatment of hypercholesterolemia, non-familial hypercholesterolemia, familial hypercholesterolemia, heterozygous familial hypercholesterolemia, homozygous familial hypercholesterolemia, mixed dyslipidemia, atherosclerosis, a risk of developing atherosclerosis, coronary heart disease, a history of coronary heart disease, early onset coronary heart disease, or one or more risk factors for coronary heart disease.

In certain embodiments, a short antisense compound targeted to a CRP nucleic acid is used for the preparation of a medicament for the treatment of acute coronary syndrome, chronic renal failure, vascular injury, arterial occlusion, atherothrombosis, unstable angina, post peripheral vascular disease, post myocardial infarction (MI), thrombosis, deep vein thrombus, end-stage renal disease (ESRD), complement activation, congestive heart failure, or systemic vasculitis. In certain embodiments, a short antisense compound targeted to a CRP nucleic acid is used for the preparation of a medicament for the treatment of an individual who has had a stroke.

In certain embodiments, a short antisense compound targeted to a CRP nucleic acid is used for the preparation of a medicament for the treatment in an individual who has undergone a procedure selected from elective stent placement, angioplasty, post percutaneous transluminal angioplasty (PTCA), cardiac transplantation, renal dialysis or cardiopulmonary bypass.

In certain embodiments, a short antisense compound targeted to a CRP nucleic acid is used for the preparation of a medicament for the treatment of an inflammatory disease. In certain such embodiments, a short antisense compound targeted to a CRP nucleic acid is used for the preparation of a medicament for the treatment of inflammatory bowel disease, ulcerative colitis, rheumatoid arthritis, or osteoarthritis.

CRP Combination Therapies

In certain embodiments, one or more pharmaceutical compositions comprising a short antisense compound targeted to a CRP nucleic acid are co-administered with one or more other pharmaceutical agents. In certain embodiments, the one or more other pharmaceutical agents is a lipid-lowering agent. In certain embodiments, such one or more other pharmaceutical agents are designed to treat the same disease or condition as the one or more pharmaceutical compositions of the present invention. In certain embodiments, such one or more other pharmaceutical agents are designed to treat a different disease or condition as the one or more pharmaceutical compositions of the present invention. In certain embodiments, such one or more other pharmaceutical agents are designed to treat an undesired effect of one or more pharmaceutical compositions of the present invention. In certain embodiments, one or more pharmaceutical compositions of the present invention are co-administered with another pharmaceutical agent to treat an undesired effect of that other pharmaceutical agent. In certain embodiments, one or more pharmaceutical compositions of the present invention and one or more other pharmaceutical agents are administered at the same time. In certain embodiments, one or more pharmaceutical compositions of the present invention and one or more other pharmaceutical agents are administered at different times. In certain embodiments, one or more pharmaceutical compositions of the present invention and one or more other pharmaceutical agents are prepared together in a single formulation. In certain embodiments, one or more pharmaceutical compositions of the present invention and one or more other pharmaceutical agents are prepared separately.

In certain embodiments, pharmaceutical agents that may be co-administered with a pharmaceutical composition comprising a short antisense compound targeted to a CRP nucleic acid include lipid-lowering agents. In certain such embodiments, pharmaceutical agents that may be co-administered with a pharmaceutical composition of the present invention include, but are not limited to atorvastatin, simvastatin, rosuvastatin, and ezetimibe. In certain such embodiments, the lipid-lowering agent is administered prior to administration of a pharmaceutical composition of the present invention. In certain such embodiments, the lipid-lowering agent is administered following administration of a pharmaceutical composition of the present invention. In certain such embodiments the lipid-lowering agent is administered at the same time as a pharmaceutical composition of the present invention. In certain such embodiments the dose of a co-administered lipid-lowering agent is the same as the dose that would be administered if the lipid-lowering agent was administered alone. In certain such embodiments the dose of a co-administered lipid-lowering agent is lower than the dose that would be administered if the lipid-lowering agent was administered alone. In certain such embodiments the dose of a co-administered lipid-lowering agent is greater than the dose that would be administered if the lipid-lowering agent was administered alone.

In certain embodiments, a co-administered lipid-lowering agent is a HMG-CoA reductase inhibitor. In certain such embodiments the HMG-CoA reductase inhibitor is a statin. In certain such embodiments the statin is selected from atorvastatin, simvastatin, pravastatin, fluvastatin, and rosuvastatin.

In certain embodiments, a co-administered lipid-lowering agent is ISIS 301012.

In certain embodiments, a co-administered lipid-lowering agent is a cholesterol absorption inhibitor. In certain such embodiments, cholesterol absorption inhibitor is ezetimibe.

In certain embodiments, a co-administered lipid-lowering agent is a co-formulated HMG-CoA reductase inhibitor and cholesterol absorption inhibitor. In certain such embodiments the co-formulated lipid-lowering agent is ezetimibe/simvastatin.

In certain embodiments, a co-administered lipid-lowering agent is a microsomal triglyceride transfer protein inhibitor (MTP inhibitor).

In certain embodiments, a co-administered pharmaceutical agent is a bile acid sequestrant. In certain such embodiments, the bile acid sequestrant is selected from cholestyramine, colestipol, and colesevelam.

In certain embodiments, a co-administered pharmaceutical agent is a nicotinic acid. In certain such embodiments, the nicotinic acid is selected from immediate release nicotinic acid, extended release nicotinic acid, and sustained release nicotinic acid.

In certain embodiments, a co-administered pharmaceutical agent is a fibric acid. In certain such embodiments, a fibric acid is selected from gemfibrozil, fenofibrate, clofibrate, bezafibrate, and ciprofibrate.

Further examples of pharmaceutical agents that may be co-administered with a pharmaceutical composition comprising a short antisense compound targeted to a CRP nucleic acid include, but are not limited to, corticosteroids, including but not limited to prednisone; immunoglobulins, including, but not limited to intravenous immunoglobulin (IVIg); analgesics (e.g., acetaminophen); anti-inflammatory agents, including, but not limited to non-steroidal anti-inflammatory drugs (e.g., ibuprofen, COX-1 inhibitors, and COX-2, inhibitors); salicylates; antibiotics; antivirals; antifungal agents; antidiabetic agents (e.g., biguanides, glucosidase inhibitors, insulins, sulfonylureas, and thiazolidenediones); adrenergic modifiers; diuretics; hormones (e.g., anabolic steroids, androgen, estrogen, calcitonin, progestin, somatostan, and thyroid hormones); immunomodulators; muscle relaxants; antihistamines; osteoporosis agents (e.g., biphosphonates, calcitonin, and estrogens); prostaglandins, antineoplastic agents; psychotherapeutic agents; sedatives; poison oak or poison sumac products; antibodies; and vaccines.

In certain embodiments, a pharmaceutical composition comprising a short antisense compound targeted to a CRP nucleic acid may be administered in conjuction with a lipid-lowering therapy. In certain such embodiments, a lipid-lowering therapy is therapeutic lifestyle change. In certain such embodiments, a lipid-lowering therapy is LDL apheresis.

Certain Short Antisense Compounds Targeted to a CRP Nucleic Acid

In certain embodiments, short antisense compounds are targeted to a CRP nucleic acid having the sequence of GENBANK® Accession No. NM_000567.1, incorporated herein as SEQ ID NO: 6. In certain such embodiments, a short antisense compound targeted to SEQ ID NO: 6 is at least 90% complementary to SEQ ID NO: 6. In certain such embodiments, a short antisense compound targeted to SEQ ID NO: 6 is at least 95% complementary to SEQ ID NO: 6. In certain such embodiments, a short antisense compound targeted to SEQ ID NO: 6 is 100% complementary to SEQ ID NO: 6. In certain embodiments, a short antisense compound targeted to SEQ ID NO: 6 comprises a nucleotide sequence selected from the nucleotide sequences set forth in Table 9.

The nucleotide sequence set forth in each SEQ ID NO in Table 9 is independent of any modification to a sugar moiety, an internucleoside linkage, or a nucleobase. As such, short antisense compounds defined by a SEQ ID NO may comprise, independently, one or more modifications to a sugar moiety, an internucleoside linkage, or a nucleobase. Short antisense compounds described by Isis Number (Isis NO.) indicate a combination of nucleobase sequence and one or more modifications to a sugar moiety, an internucleoside linkage, or a nucleobase.

Table 9 illustrates examples of short antisense compounds targeted to SEQ ID NO: 6. Table 9 illustrates short antisense compounds that are 100% complementary to SEQ ID NO: 6.

The column labeled 'gapmer motif' indicates the wing-gap-wing motif of each short antisense compounds. The gap segment comprises 2'-deoxynucleotides and each nucleotide of each wing segment comprises a 2'-modified sugar. The particular 2'-modified sugar is also indicated in the 'gapmer motif' column. For example, '2-10-2 MOE' means a 2-10-2 gapmer motif, where a gap segment of ten 2'-deoxynucleotides is flanked by wing segments of two nucleotides, where the nucleotides of the wing segments are 2'-MOE nucleotides. Internucleoside linkages are phosphorothioate. The short antisense compounds comprise 5-methylcytidine in place of unmodified cytosine, unless "unmodified cytosine" is listed in the gapmer motif column, in which case the indicated cytosines are unmodified cytosines. For example, "5-mC in gap only" indicates that the gap segment has 5-methylcytosines, while the wing segments have unmodified cytosines.

In certain embodiments, short antisense compounds targeting a CRP nucleic acid may have any one or more properties or characteristics of the short antisense compounds generally described herein. In certain embodiments, short antisense compounds targeting a CRP nucleic acid have a motif (wing-deoxy gap-wing) selected from 1-12-1, 1-1-10-2, 2-10-1-1, 3-10-3, 2-10-3, 2-10-2, 1-10-1, 1-10-2, 3-8-3, 2-8-2, 1-8-1, 3-6-3 or 1-6-1, more preferably 1-10-1, 2-10-2, 3-10-3, and 1-9-2.

TABLE 9

Short Antisense Compounds targeted to SEQ ID NO: 6

| ISIS NO. | 5' Target Site | 3' Target Site | Sequence (5'-3') | Gapmer Motif | Seq ID NO |
|---|---|---|---|---|---|
| 353506 | 1257 | 1272 | ACTCTGGACCCAAACC | 3-10-3 MOE | 409 |
| 353507 | 1258 | 1271 | CTCTGGACCCAAAC | 2-10-2 MOE | 410 |
| 353484 | 1305 | 1320 | CCATTTCAGGAGACCT | 3-10-3 MOE | 411 |
| 353485 | 1306 | 1319 | CATTTCAGGAGACC | 2-10-2 MOE | 412 |

In certain embodiments, a target region is nucleotides 1305-1320 of NM_000567.1. In certain such embodiments, short antisense compounds targeted to nucleotides 1305-1320 of NM_000567.1 comprise a nucleotide sequence selected from SEQ ID NO: 1305 or 1306. In certain such embodiments, a short antisense compound targeted to nucleotides 263-278 of NM_000567.1 is selected from Isis NO. 353484 or 353485.

In certain embodiments, a target region is nucleotides 1257-1272 of NM_000567.1. In certain such embodiments, a short antisense compound targeted to nucleotides 1257-1272 of NM_000567.1 comprises a nucleotide sequence selected from SEQ ID NO 1257 or 1258. In certain such embodiments, a short antisense compound targeted to nucleotides 428-483 of NM_000567.1 is selected from Isis NO. 353506 or 353507.

In certain embodiments, short antisense compounds targeted to a CRP nucleic acid are 8 to 16, preferably 9 to 15, more preferably 9 to 14, more preferably 10 to 14 nucleotides in length. In certain embodiments, short antisense compounds targeted to a CRP nucleic acid are 9 to 14 nucleotides in length. In certain embodiments, short antisense compounds targeted to a CRP nucleic acid are 10 to 14 nucleotides in length. In certain embodiments, such short antisense compounds are short antisense oligonucleotides.

In certain embodiments, short antisense compounds targeted to a CRP nucleic acid are short gapmers. In certain such embodiments, short gapmers targeted to a CRP nucleic acid comprise at least one high affinity modification in one or more wings of the compound. In certain embodiments, short antisense compounds targeted to a CRP nucleic acid comprise 1 to 3 high-affinity modifications in each wing. In certain such embodiments, the nucleosides or nucleotides of the wing comprise a 2' modification. In certain such embodiments, the monomers of the wing are BNA's. In certain such embodiments, the monomers of the wing are selected from α-L-Methyleneoxy (4'-CH$_2$—O-2') BNA, β-D-Methyleneoxy (4'-CH$_2$—O-2') BNA, Ethyleneoxy (4'-(CH$_2$)$_2$—O-2') BNA, Aminooxy (4'-CH$_2$—O—N(R)-2') BNA and Oxyamino (4'-CH$_2$—N(R)—O-2') BNA. In certain embodiments, the monomers of a wing comprise a substituent at the 2' position selected from allyl, amino, azido, thio, O-allyl, O—C$_1$-C$_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), and O—CH$_2$—C(=O)—N(R$_m$)(R$_n$), where each R$_m$ and R$_n$ is, independently, H or substituted or unsubstituted C$_1$-C$_{10}$ alkyl. In certain embodiments, the monomers of a wing are 2'MOE nucleotides.

In certain embodiments, short antisense compounds targeted to a CRP nucleic acid comprise a gap between the 5' wing and the 3' wing. In certain embodiments the gap comprises five, six, seven, eight, nine, ten, eleven, twelve, thirteen, or fourteen monomers. In certain embodiments, the monomers of the gap are unmodified deoxyribonucleotides. In certain embodiments, the monomers of the gap are unmodified ribonucleotides. In certain embodiments, gap modifications (if any) gap result in an antisense compound that, when bound to its target nucleic acid, supports cleavage by an RNase, including, but not limited to, RNase H.

In certain embodiments, short antisense compounds targeted to a CRP nucleic acid have uniform monomeric linkages. In certain such embodiments, those linkages are all phosphorothioate linkages. In certain embodiments, the linkages are all phosphodiester linkages. In certain embodiments, short antisense compounds targeted to a CRP nucleic acid have mixed backbones.

In certain embodiments, short antisense compounds targeted to a CRP nucleic acid are 8 monomers in length. In certain embodiments, short antisense compounds targeted to a CRP nucleic acid are 9 monomers in length. In certain embodiments, short antisense compounds targeted to a CRP nucleic acid are 10 monomers in length. In certain embodiments, short antisense compounds targeted to a CRP nucleic acid are 11 monomers in length. In certain embodiments, short antisense compounds targeted to a CRP nucleic acid are monomers in length. In certain embodiments, short antisense compounds targeted to a CRP nucleic acid are 13 monomers in length. In certain embodiments, short antisense compounds targeted to a CRP nucleic acid are 14 monomers in length. In certain embodiments, short antisense compounds targeted to a CRP nucleic acid are 15 monomers in length. In certain embodiments, short antisense compounds targeted to a CRP nucleic acid are 16 monomers in length. In certain embodiments, short antisense compounds targeted to a CRP nucleic acid comprise 9 to 15 monomers. In certain embodiments, short antisense compounds targeted to a CRP nucleic acid comprise 10 to 15 monomers. In certain embodiments, short antisense compounds targeted to a CRP nucleic acid comprise 12 to 14 monomers. In certain embodiments, short antisense compounds targeted to a CRP nucleic acid comprise 12 to 14 nucleotides or nucleosides.

In certain embodiments, the invention provides methods of modulating expression of CRP. In certain embodiments, such methods comprise use of one or more short antisense compound targeted to a CRP nucleic acid, wherein the short antisense compound targeted to a CRP nucleic acid is from about 8 to about 16, preferably 9 to 15, more preferably 9 to 14, more preferably 10 to 14 monomers (i.e. from about 8 to about 16 linked monomers). One of ordinary skill in the art will appreciate that this comprehends methods of modulating expression of CRP using one or more short antisense compounds targeted to a CRP nucleic acid of 8, 9, 10, 11, 12, 13, 14, 15 or 16 monomers.

In certain embodiments, methods of modulating CRP comprise use of a short antisense compound targeted to a CRP nucleic acid that is 8 monomers in length. In certain embodiments, methods of modulating CRP comprise use of a short antisense compound targeted to a CRP nucleic acid that is 9 monomers in length. In certain embodiments, methods of modulating CRP comprise use of a short antisense compound targeted to a CRP nucleic acid that is 10 monomers in length. In certain embodiments, methods of modulating CRP comprise use of a short antisense compound targeted to a CRP nucleic acid that is 11 monomers in length. In certain embodiments, methods of modulating CRP comprise use of a short antisense compound targeted to a CRP nucleic acid that is 12 monomers in length. In certain embodiments, methods of modulating CRP comprise use of a short antisense compound targeted to a CRP nucleic acid that is 13 monomers in length. In certain embodiments, methods of modulating CRP comprise use of a short antisense compound targeted to a CRP nucleic acid that is 14 monomers in length. In certain embodiments, methods of modulating CRP comprise use of a short antisense compound targeted to a CRP nucleic acid that is 15 monomers in length. In certain embodiments, methods of modulating CRP comprise use of a short antisense compound targeted to a CRP nucleic acid that is 16 monomers in length.

In certain embodiments, methods of modulating expression of CRP comprise use of a short antisense compound targeted to a CRP nucleic acid comprising 9 to 15 monomers. In certain embodiments, methods of modulating expression of CRP comprise use of a short antisense compound targeted to a CRP nucleic acid comprising 10 to 15 monomers. In certain embodiments, methods of modulating expression of CRP comprise use of a short antisense compound targeted to a CRP nucleic acid comprising 12 to 14 monomers. In certain embodiments, methods of modulating expression of CRP comprise use of a short antisense compound targeted to a CRP nucleic acid comprising 12 or 14 nucleotides or nucleosides.

6. Glucocorticoid Receptor (GCCR)

Glucocorticoids were among the first steroid hormones to be identified and are responsible for a multitude of physiological functions, including the stimulation of gluconeogenesis, decreased glucose uptake and utilization in peripheral tissues, increased glycogen deposition, suppression of immune and inflammatory responses, inhibition of cytokine synthesis and acceleration of various developmental events. Glucocorticoids are also especially important for combating stress. Stress-induced elevation of glucocorticoid synthesis and release leads to, among other responses, increased ventricular workload, inhibition of inflammatory mediators, inhibition of cytokine synthesis and increased glucose production (Karin, *Cell,* 1998, 93, 487-490).

Both natural glucocorticoids and their synthetic derivatives exert their action through the glucocorticoid receptor, a ubiquitously expressed cytoplasmic member of the nuclear hormone superfamily of receptors. Human glucocorticoid receptor is also known as nuclear receptor subfamily 3, group C, member 1; NR3C1; GCCR; GCR; GRL; Glucocorticoid receptor, lymphocyte. The gene is located on human chromosome 5q11-q13 and consists of 9 exons (Encio and Detera-Wadleigh, *J Biol Chem*, 1991, 266, 7182-7188; Gehring et al., *Proc Natl Acad Sci USA*, 1985, 82, 3751-3755). Multiple forms of human glucocorticoid receptor mRNA exist: a 5.5 kb human glucocorticoid receptor a cDNA containing exons 1-8 and exon 9α; a 4.3 kb human glucocorticoid receptor 0 cDNA containing exons 1-8 and exon 9O; and a 7.0 kb human glucocorticoid receptor a cDNA containing exons 1-8 and the entire exon 9, which includes exon 9α, exon 9β and the 'J region', which is flanked by exons 9α and 9β (Hollenberg et al., *Nature*, 1985, 318, 635-641; Oakley et al., *J Biol Chem*, 1996, 271, 9550-9559). Human glucocorticoid receptor a is the predominant isoform of the receptor and the one that exhibits steroid binding activity (Hollenberg et al., *Nature*, 1985, 318, 635-641). Additionally, through usage of three different promoters three different exon 1 variants can be transcribed, and alternative splicing of one exon 1 variant can result in three different versions of this exon. Thus, human glucocorticoid receptor mRNA may contain 5 different versions of exon 1 (Breslin et al., *Mol Endocrinol*, 2001, 15, 1381-1395).

Examination of the expression patterns of the α and β isoforms of human glucocorticoid receptor mRNA reveals that the a isoform is more abundantly expressed. Both isoforms are expressed in similar tissues and cell types, including lung, kidney, heart, liver, skeletal muscle, macrophages, neutrophils and peripheral blood mononuclear cells. Only human glucocorticoid receptor a is expressed in colon. At the level of protein, while the α isoform is detected in all tissues examined, the β isoform is undetectable, suggesting that under physiological conditions, the default splicing pathway is the one that produces the α isoform (Pujols et al., *Am J Physiol Cell Physiol*, 2002, 283, C1324-1331). The β isoform of glucocorticoid receptor binds neither a glucocorticoid agonist nor an antagonist. Furthermore, the β isoform is localized primarily in the nucleus in transfected cells, independent of hormone stimulation. When both isoforms are expressed in the same cell, the glucocorticoid receptor β inhibits the hormone-induced, glucocorticoid receptor α-mediated stimulation of gene expression, suggesting that the β isoform functions as an inhibitor of glucocorticoid receptor α activity (Oakley et al., *J Biol Chem*, 1996, 271, 9550-9559). Unless otherwise noted, the human glucocorticoid receptor described herein is defined as the ubiquitous product(s) of the gene located on chromosome 5q11-q13.

Cell lines transfected with a complementary glucocorticoid receptor antisense RNA strand exhibited a reduction in glucocorticoid receptor mRNA levels and a decreased response to the glucocorticoid receptor agonist dexamethasone (Pepin and Barden, *Mol Cell Biol*, 1991, 11, 1647-1653). Transgenic mice bearing an antisense glucocorticoid receptor gene construct were used to study the glucocorticoid feedback effect on the hypothalamus-pituitary-adrenal axis (Pepin et al., *Nature*, 1992, 355, 725-728). In another study of similarly genetically engineered mice, energy intake and expenditure, heart and vastus lateralis muscle lipoprotein lipase activity, and heart and brown adipose tissue norepinephrine were lower than in control animals. Conversely, fat content and total body energy were significantly higher than in control animals. These results suggest that a defective glucocorticoid receptor system may affect energy balance through increasing energetic efficiency, and they emphasize the modulatory effects of hypothalamic-pituitary-adrenal axis changes on muscle lipoprotein lipase activity (Richard et al., *Am J Physiol*, 1993, 265, R146-150).

Behavorial effects of glucocorticoid receptor antagonists have been measured in animal models designed to assess anxiety, learning and memory. Reduced expression of glucocorticoid receptor in rats long-term intracerebroventricularly infused with antisense oligodeoxynucleotides targeting glucocorticoid receptor mRNA did not interfere with spatial navigation in the Morris water maze test (Engelmann et al., *Eur J Pharmacol*, 1998, 361, 17-26). Bilateral infusion of an antisense oligodeoxynucleotide targeting the glucocorticoid receptor mRNA into the dentate gyrus of the rat hippocampus reduced the immobility of rats in the Porsolt forced swim test (Korte et al., *Eur J Pharmacol*, 1996, 301, 19-25).

Glucocorticoids are frequently used for their immunosuppressive, anti-inflammatory effects in the treatment of diseases such as allergies, athsma, rheumatoid arthritis, AIDS, systemic lupus erythematosus and degenerative osteoarthritis. Negative regulation of gene expression, such as that caused by the interaction of glucocorticoid receptor with NF-kB, is proposed to be at least partly responsible for the anti-inflammatory action of glucocorticoids in vivo. Interleukin-6, tumor necrosis factor α and interleukin-1 are the three cytokines that account for most of the hypothalamic-pituitary-adrenal (HPA) axis stimulation during the stress of inflammation. The HPA axis and the systemic sympathetic and adrenomedullary system are the peripheral components of the stress system, responsible for maintaining basal and stress-related homeostasis. Glucocorticoids, the end products of the HPA axis, inhibit the production of all three inflammatory cytokines and also inhibit their effects on target tissues, with the exception of interleukin-6, which acts synergistically with glucocorticoids to stimulate the production of acute-phase reactants. Glucocorticoid treatment decreases the activity of the HPA axis (Chrousos, N Engl J Med, 1995, 332, 1351-1362).

In some cases, patients are refractory to glucocorticoid treatment. One reason for this resistance to steroids lies with mutations or polymorphisms present in the glucocorticoid receptor gene. A total of 15 missense, three nonsense, three frameshift, one splice site, and two alternative spliced mutations, as well as 16 polymorphisms, have been reported in the NR3C1 gene in association with glucocorticoid resistance (Bray and Cotton, Hum Mutat, 2003, 21, 557-568). Additional studies in humans have suggested a positive association between metabolic syndrome incidence and progression, with alleles at the glucocorticoid receptor (GR) gene (Rosmond, Obes Res, 2002, 10, 1078-1086).

Other cases of glucocorticoid insensitivity are associated with altered expression of glucocorticoid receptor isoforms. A study of human glucocorticoid receptor β isoform mRNA expression in glucocorticoid-resistant ulcerative colitis patients revealed the presence of this mRNA was significantly higher than in the glucocorticoid-sensitive patients, suggesting that the expression of human glucocorticoid receptor β mRNA in the peripheral blood mononuclear cells may serve as a predictor of glucocorticoid response in ulcerative colitis (Honda et al., Gastroenterology, 2000, 118, 859-866). Increased expression of glucocorticoid receptor β is also observed in a significantly high number of glucocorticoid-insensitive asthmatics. Additionally, cytokine-induced abnormalities in the DNA binding capacity of the glucocorticoid receptor were found in peripheral blood mononuclear cells from glucocorticoid-insensitive patients transfection, and HepG2 cells with the glucocorticoid receptor β gene resulted in a significant reduction of glucocorticoid receptor a DNA-binding capacity (Leung et al., J Exp Med, 1997, 186, 1567-1574). Dexamethasone binding studies demonstrate that human glucocorticoid receptor β does not alter the affinity of glucocorticoid receptor a for hormonal ligands, but rather its ability to bind to the GRE (Bamberger et al., J Clin Invest, 1995, 95, 2435-2441). Taken together, these results illustrate that glucocorticoid receptor β, through competition with glucocorticoid receptor a for GRE target sites, may function as a physiologically and pathophysiologically relevant endogenous inhibitor of glucocorticoid action.

In the liver, glucocorticoid agonists increase hepatic glucose production by activating the glucocorticoid receptor, which subsequently leads to increased expression of the gluconeogenic enzymes phosphoenolpyruvate carboxykinase (PEPCK) and glucose-6-phosphatase. Through gluconeogenesis, glucose is formed through non-hexose precursors, such as lactate, pyruvate and alanine (Link, Curr Opin Investig Drugs, 2003, 4, 421-429). Steroidal glucocorticoid receptor antagonists such as RU 486 have been tested in rodent models of diabetes. Mice deficient in the leptin receptor gene, termed db/db mice, are genetically obese, diabetic and hyperinsulinemic. Treatment of hyperglycemic db/db mice with RU 486 decreased blood glucose levels by approximately 49%, without affecting plasma insulin levels. Additionally, RU 486 treatment reduced the expression of glucocorticoid receptor responsive genes PEPCK, glucose-6-phosphatase, glucose transporter type 2 and tyrosine aminotransferase in db/db mice as compared to untreated animals (Friedman et al., J Biol Chem, 1997, 272, 31475-31481). RU 486 also ameliorates diabetes in the ob/ob mouse model of diabetes, obesity and hyperinsulinemia, through a reduction in serum insulin and blood glucose levels (Gettys et al., Int J Obes Relat Metab Disord, 1997, 21, 865-873).

As increased gluconeogenesis is considered to be the major source of increased glucose production in diabetes, a number of therapeutic targets for the inhibition of hepatic glucose production have been investigated. Due to the ability of antagonists of the glucocorticoid receptor to ameliorate diabetes in animal models, such compounds are among the potential therapies being explored. However, there are detrimental systemic effects of glucocorticoid receptor antagonists, including activation of the HPA axis (Link, Curr Opin Investig Drugs, 2003, 4, 421-429). Increased HPA axis activity is associated with suppression of immune-related inflammatory action, which can increase susceptibility to infectious agents and neoplasms. Conditions associated with suppression of immune-mediated inflammation through defects in the HPA axis, or its target tissues, include Cushing's syndrome, chronic stress, chronic alcoholism and melancholic depression (Chrousos, N Engl J Med, 1995, 332, 1351-1362). Thus, it is of great value to develop liver-specific glucocorticoid receptor antagonists. Steroidal glucocorticoid receptor antagonists have been conjugated to bile acids for the purpose of targeting them to the liver (Apelqvist et al., 2000). Currently, there are no known therapeutic agents that target the glucocorticoid receptor without undesired peripheral effects (Link, Curr Opin Investig Drugs, 2003, 4, 421-429). Consequently, there remains a long felt need for agents capable of effectively inhibiting hepatic glucocorticoid receptor.

Definitions

"Glucocorticoid receptor" is the gene product or protein of which expression is to be modulated by administration of a short antisense compound. Glucocorticoid receptor is generally referred to as GCCR.

"GCCR nucleic acid" means any nucleic acid encoding GCCR. For example, in certain embodiments, a GCCR nucleic acid includes, without limitation, a DNA sequence encoding GCCR, an RNA sequence transcribed from DNA encoding GCCR, and an mRNA sequence encoding GCCR. "GCCR mRNA" means an mRNA encoding GCCR.

Therapeutic Indications

Antisense technology is an effective means of reducing the expression of specific gene products and therefore is useful in a number of therapeutic, diagnostic and research applications for the modulation of glucocorticoid receptor expression. Furthermore, in certain embodiments, liver is one of the tissues in which the highest concentrations of antisense oligonucleotides are found following administration (Geary et al., Curr. Opin. Investig. Drugs, 2001, 2, 562-573). Therefore, in such embodiments, antisense technology represents an attractive method for the liver-specific inhibition of glucocorticoid receptor.

In certain embodiments, short antisense compounds targeted to a nucleic acid encoding glucocorticoid receptor are preferentially distributed to the liver. In certain embodiments, short antisense compounds have increased potency in the liver when compared to a longer parent compound. In certain embodiments, target RNA is predominantly expressed in the liver.

For therapeutics, a subject, suspected of having a disease or disorder which can be treated by modulating the expression of GCCR is treated by administering one or more short antisense compound. In a non-limiting example, the methods comprise the step of administering to an animal a therapeutically effective amount of a short antisense compound. Certain short antisense compounds inhibit the activity of GCCR and/or inhibit expression of GCCR. In certain embodiments, the activity or expression of GCCR in a subject is inhibited by at least 10%, by at least 20%, by at least 25%, by at least 30%, by at least 40%, by at least 50%, by at least 60%, by at least 70%, by at least 75%, by at least 80%, by at least 85%, by at least 90%, by at least 95%, by at least 98%, by at least 99%, or by 100%. In certain embodiments, the activity or expression of GCCR in a subject is inhibited by at least 30%. In certain embodiments, the activity or expression of GCCR in a subject is inhibited by at least 50% or more.

The reduction of the expression of GCCR may be measured, for example, in blood, plasma, serum, adipose tissue, liver or any other body fluid, tissue or organ of the animal. In certain embodiments, cells contained within such fluids, tissues or organs being analyzed comprise nucleic acids encoding GCCR and/or they contain the GCCR protein itself.

Certain pharmaceutical and other compositions comprising short antisense compounds are also provided. In certain embodiments, short antisense compounds are be utilized in pharmaceutical compositions by adding to them an effective amount of a compound to a suitable pharmaceutically acceptable diluent or carrier.

In certain embodiments, short antisense compounds targeting a GCCR nucleic acid have any one or more properties or characteristics of the short antisense compounds generally described herein. In certain embodiments, short antisense compounds targeting a GCCR nucleic acid have a motif (wing-deoxy gap-wing) selected from 1-12-1, 1-1-10-2, 2-10-1-1, 3-10-3, 2-10-3, 2-10-2, 1-10-1, 1-10-2, 3-8-3, 2-8-2, 1-8-1, 3-6-3 or 1-6-1. In certain embodiments, short antisense compounds targeting a GCCR nucleic acid have a motif (wing-deoxy gap-wing) selected from 1-10-1, 2-10-2, 3-10-3, and 1-9-2. In certain embodiments, short antisense compounds targeting a GCCR nucleic acid have a motif (wing-deoxy gap-wing) selected from 3-10-3, 2-10-3, 2-10-2, 1-10-1, 1-10-2, 2-8-2, 1-8-1, 3-6-3 or 1-6-1, more preferably 2-10-2 and 2-8-2.

In certain embodiments, provided herein are methods of treating an individual by administering one or more short antisense compound targeted to a GCCR nucleic acid or a pharmaceutical composition comprising such compound.

Further provided are methods of treating a subject having a disease or conditions associated with GCCR activity by administering a short antisense compound targeted to a GCCR nucleic acid. In addition to diabetes, particularly type 2 diabetes, diseases and conditions associated with GCCR include but are not limited to, obesity, Metabolic syndrome X, Cushing's Syndrome, Addison's disease, inflammatory diseases such as asthma, rhinitis and arthritis, allergy, autoimmune disease, immunodeficiency, anorexia, cachexia, bone loss or bone frailty, and wound healing. Metabolic syndrome, metabolic syndrome X or simply Syndrome X refers to a cluster of risk factors that include obesity, dyslipidemia, particularly high blood triglycerides, glucose intolerance, high blood sugar and high blood pressure. In certain embodiments, short antisense compounds targeted to GCCR are used for amelioration of hyperglycemia induced by systemic steroid therapy. Moreover, antisense technology provides a means of inhibiting the expression of the glucocorticoid receptor β isoform, demonstrated to be overexpressed in patients refractory to glucocorticoid treatment.

In certain embodiments, the invention provides short antisense compounds targeted to a nucleic acid encoding GCGR, and which modulate the expression of glucocorticoid receptor. Pharmaceutical and other compositions comprising the compounds of the invention are also provided. Further provided are methods of screening for modulators of glucocorticoid receptor and methods of modulating the expression of glucocorticoid receptor in cells, tissues or animals comprising contacting said cells, tissues or animals with one or more of the compounds or compositions of the invention. Methods of treating an animal, particularly a human, suspected of having or being prone to a disease or condition associated with expression of glucocorticoid receptor are also set forth herein. Such methods comprise administering a therapeutically or prophylactically effective amount of one or more of the compounds or compositions of the invention to the person in need of treatment.

Certain Short Antisense Compounds Targeted to a GCCR Nucleic Acid

In certain embodiments, short antisense compounds are targeted to a GCCR nucleic acid having the sequence of nucleotides 1 to 106000 of GENBANK®V Accession No. AC012634, incorporated herein as SEQ ID NO: 8. In certain such embodiments, a short antisense compound targeted to SEQ ID NO: 8 is at least 90% complementary to SEQ ID NO: 8. In certain such embodiments, a short antisense compound targeted to SEQ ID NO: 8 is at least 95% complementary to SEQ ID NO: 8. In certain such embodiments, a short antisense compound targeted to SEQ ID NO: 8 is 100% complementary to SEQ ID NO: 8. In certain embodiments, a short antisense compound targeted to SEQ ID NO: 8 includes a nucleotide sequence selected from the nucleotide sequences set forth in Tables 10 and 11.

The nucleotide sequence set forth in each SEQ ID NO in Tables 10 and 11 is independent of any modification to a sugar moiety, an internucleoside linkage, or a nucleobase. As such, short antisense compounds defined by a SEQ ID NO may comprise, independently, one or more modifications to a sugar moiety, an internucleoside linkage, or a nucleobase. Short antisense compounds described by Isis Number (Isis NO.) indicate a combination of nucleobase sequence and one or more modifications to a sugar moiety, an internucleoside linkage, or a nucleobase.

In certain embodiments, short antisense compounds targeted to a GCCR nucleic acid comprise a gapmer motif. In certain embodiments, a short antisense compound targeted to a GCCR nucleic acid comprises a 2-10-2 gapmer motif.

Tables 10 and 11 illustrate examples of short antisense compounds targeted to SEQ ID NO: 8. Table 10 illustrates short antisense compounds that are 100% complementary to SEQ ID NO: 8. Table 11 illustrates short antisense compounds that have one or two mismatches with respect to SEQ ID NO: 8. The column labeled 'gapmer motif' indicates the wing-gap-wing motif of each short antisense compounds. The gap segment comprises 2'-deoxynucleotides and each nucleotide of each wing segment comprises a 2'-modified sugar. The particular 2'-modified sugar is also indicated in the 'gapmer motif' column. For example, '2-10-2 MOE' means a 2-10-2 gapmer motif, where a gap segment of ten 2'-deoxynucleotides is flanked by wing segments of two nucleotides, where the nucleotides of the wing segments are 2'-MOE nucleotides. Internucleoside linkages are phosphorothioate. The short antisense compounds comprise 5-methylcytidine in place of unmodified cytosine, unless "unmodified cytosine" is listed in the gapmer motif column, in which case the indicated cytosines are unmodified cytosines. For example, "5-mC in gap only" indicates that the gap segment has 5-methylcytosines, while the wing segments have unmodified cytosines.

TABLE 10

Short Antisense Compounds targeted to SEQ ID NO: 8

| ISIS NO. | 5' Target Site | 3' Target Site | Sequence (5'-3') | Gapmer Motif | SEQ ID NO |
|---|---|---|---|---|---|
| 371644 | 88142 | 88155 | TTTGGGAGGTGGTC | 2-10-2 MOE | 413 |
| 371645 | 88156 | 88169 | CACACCAGGCAGAG | 2-10-2 MOE | 414 |
| 371649 | 88212 | 88225 | CTTTACAGCTTCCA | 2-10-2 MOE | 415 |
| 371651 | 88242 | 88255 | CACTACCTTCCACT | 2-10-2 MOE | 416 |
| 371652 | 88248 | 88261 | AACACACACTACCT | 2-10-2 MOE | 417 |
| 371653 | 88256 | 88269 | CTCTTCAAAACACA | 2-10-2 MOE | 418 |
| 371665 | 92037 | 92050 | GTAATTGTGCTGTC | 2-10-2 MOE | 419 |
| 371669 | 92086 | 92099 | TTTTTCTTCGAATT | 2-10-2 MOE | 420 |
| 371671 | 92114 | 92127 | CATTTTCGATAGCG | 2-10-2 MOE | 421 |
| 371673 | 92142 | 92155 | ACCTTCCAGGTTCA | 2-10-2 MOE | 422 |

TABLE 11

Short antisense compounds targeted to SEQ ID NO: 8 and having 1 or 2 mismatches

| ISIS NO | 5' Target Site | 3' Target Site | Sequence (5'-3') | Gapmer Motif | SEQ ID NO |
|---|---|---|---|---|---|
| 371638 | 2039 | 2052 | ATAGGAAGCATAAA | 2-10-2 MOE | 423 |
| 371650 | 4949 | 4962 | TCTTTTAAAGAAGA | 2-10-2 MOE | 424 |
| 371673 | 10187 | 10200 | ACCTTCCAGGTTCA | 2-10-2 MOE | 422 |
| 371660 | 13465 | 13478 | AAGGATATTTTAAA | 2-10-2 MOE | 425 |
| 371660 | 14428 | 14441 | AAGGATATTTTAAA | 2-10-2 MOE | 425 |
| 371654 | 15486 | 15499 | GAACAAAAATTAAA | 2-10-2 MOE | 427 |
| 371661 | 16638 | 16651 | TTCCACAGATCTGT | 2-10-2 MOE | 428 |

TABLE 11-continued

Short antisense compounds targeted to SEQ ID NO: 8 and having 1 or 2 mismatches

| ISIS NO | 5' Target Site | 3' Target Site | Sequence (5'-3') | Gapmer Motif | SEQ ID NO |
|---|---|---|---|---|---|
| 371653 | 17892 | 17905 | CTCTTCAAAACACA | 2-10-2 MOE | 418 |
| 371679 | 18444 | 18457 | TTTATAAAGTAAAG | 2-10-2 MOE | 429 |
| 371645 | 19816 | 19829 | CACACCAGGCAGAG | 2-10-2 MOE | 414 |
| 371638 | 21555 | 21568 | ATAGGAAGCATAAA | 2-10-2 MOE | 423 |
| 371650 | 21775 | 21788 | TCTTTTAAAGAAGA | 2-10-2 MOE | 424 |
| 371679 | 21902 | 21915 | TTTATAAAGTAAAG | 2-10-2 MOE | 429 |
| 371655 | 22507 | 22520 | TACTGTGAGAAATA | 2-10-2 MOE | 433 |
| 371655 | 22722 | 22735 | TACTGTGAGAAATA | 2-10-2 MOE | 433 |
| 371672 | 25662 | 25675 | TTCCAGCTTGAAGA | 2-10-2 MOE | 435 |
| 371678 | 25926 | 25939 | GATCAGTTCTCATG | 2-10-2 MOE | 436 |
| 371655 | 26041 | 26054 | TACTGTGAGAAATA | 2-10-2 MOE | 433 |
| 371638 | 29770 | 29783 | ATAGGAAGCATAAA | 2-10-2 MOE | 423 |
| 371668 | 30551 | 30564 | TTATCAATGATGCA | 2-10-2 MOE | 439 |
| 371670 | 40584 | 40597 | GCATGCTGGACAGT | 2-10-2 MOE | 440 |
| 371654 | 43331 | 43344 | GAACAAAAATTAAA | 2-10-2 MOE | 427 |
| 371650 | 46024 | 46037 | TCTTTTAAAGAAGA | 2-10-2 MOE | 424 |
| 371659 | 50372 | 50385 | TTGCACCTGAACTA | 2-10-2 MOE | 443 |
| 371634 | 50565 | 50578 | CAGAATATATTTCT | 2-10-2 MOE | 444 |
| 371673 | 56942 | 56955 | ACCTTCCAGGTTCA | 2-10-2 MOE | 422 |
| 371654 | 62372 | 62385 | GAACAAAAATTAAA | 2-10-2 MOE | 427 |
| 371679 | 63537 | 63550 | TTTATAAAGTAAAG | 2-10-2 MOE | 429 |
| 371654 | 64908 | 64921 | GAACAAAAATTAAA | 2-10-2 MOE | 427 |
| 371661 | 65795 | 65808 | TTCCACAGATCTGT | 2-10-2 MOE | 428 |
| 371645 | 70997 | 71010 | CACACCAGGCAGAG | 2-10-2 MOE | 414 |
| 371661 | 77400 | 77413 | TTCCACAGATCTGT | 2-10-2 MOE | 428 |
| 371663 | 82329 | 82342 | ATAAGAGATTAAAA | 2-10-2 MOE | 450 |
| 371633 | 83426 | 83439 | TCCCCCTTCTCATT | 2-10-2 MOE | 451 |
| 371662 | 85873 | 85886 | GGGCATTGTTAAAA | 2-10-2 MOE | 452 |
| 371654 | 86476 | 86489 | GAACAAAAATTAAA | 2-10-2 MOE | 427 |
| 371679 | 86516 | 86529 | TTTATAAAGTAAAG | 2-10-2 MOE | 429 |
| 371641 | 88097 | 88110 | AGAACTCACATCTG | 2-10-2 MOE | 455 |
| 371642 | 88111 | 88124 | GAGCTGGACGGAGG | 2-10-2 MOE | 456 |
| 371646 | 88170 | 88183 | AAGCTTCATCGGAG | 2-10-2 MOE | 457 |
| 371647 | 88184 | 88197 | ATAATGGCATCCCG | 2-10-2 MOE | 458 |
| 371650 | 88226 | 88239 | TCTTTTAAAGAAGA | 2-10-2 MOE | 424 |
| 371673 | 91493 | 91506 | ACCTTCCAGGTTCA | 2-10-2 MOE | 422 |
| 371664 | 92030 | 92043 | TGCTGTCCTATAAG | 2-10-2 MOE | 460 |
| 371666 | 92044 | 92057 | CACAAAGGTAATTG | 2-10-2 MOE | 461 |
| 371667 | 92058 | 92071 | ATCATTTCTTCCAG | 2-10-2 MOE | 462 |
| 371668 | 92072 | 92085 | TTATCAATGATGCA | 2-10-2 MOE | 463 |
| 371670 | 92100 | 92113 | GCATGCTGGACAGT | 2-10-2 MOE | 440 |
| 371672 | 92128 | 92141 | TTCCAGCTTGAAGA | 2-10-2 MOE | 435 |
| 371674 | 92147 | 92160 | CCATTACCTTCCAG | 2-10-2 MOE | 466 |
| 371637 | 92983 | 92996 | GCATAAACAGGGTT | 2-10-2 MOE | 467 |
| 371654 | 93928 | 93941 | GAACAAAAATTAAA | 2-10-2 MOE | 427 |
| 371641 | 99772 | 99785 | AGAACTCACATCTG | 2-10-2 MOE | 455 |
| 371679 | 99883 | 99896 | TTTATAAAGTAAAG | 2-10-2 MOE | 429 |
| 371660 | 99933 | 99946 | AAGGATATTTTAAA | 2-10-2 MOE | 425 |
| 371635 | 105004 | 105017 | TATGAAAGGAATGT | 2-10-2 MOE | 472 |
| 371654 | 105028 | 105041 | GAACAAAAATTAAA | 2-10-2 MOE | 427 |
| 371676 | 106482 | 106495 | TTCCTTAAGCTTCC | 2-10-2 MOE | 474 |
| 371650 | 107838 | 107851 | TCTTTTAAAGAAGA | 2-10-2 MOE | 424 |
| 371673 | 110922 | 110935 | ACCTTCCAGGTTCA | 2-10-2 MOE | 422 |
| 371673 | 111580 | 111593 | ACCTTCCAGGTTCA | 2-10-2 MOE | 422 |
| 371634 | 114608 | 114621 | CAGAATATATTTCT | 2-10-2 MOE | 444 |
| 371638 | 115040 | 115053 | ATAGGAAGCATAAA | 2-10-2 MOE | 423 |
| 371660 | 116244 | 116257 | AAGGATATTTTAAA | 2-10-2 MOE | 425 |
| 371663 | 116657 | 116670 | ATAAGAGATTAAAA | 2-10-2 MOE | 450 |
| 371673 | 118068 | 118081 | ACCTTCCAGGTTCA | 2-10-2 MOE | 422 |
| 371666 | 118834 | 118847 | CACAAAGGTAATTG | 2-10-2 MOE | 461 |
| 371660 | 119858 | 119871 | AAGGATATTTTAAA | 2-10-2 MOE | 425 |
| 371660 | 120210 | 120223 | AAGGATATTTTAAA | 2-10-2 MOE | 425 |
| 371662 | 120876 | 120889 | GGGCATTGTTAAAA | 2-10-2 MOE | 452 |
| 371655 | 124004 | 124017 | TACTGTGAGAAATA | 2-10-2 MOE | 433 |
| 371656 | 124170 | 124183 | GAACAGTTAAACAT | 2-10-2 MOE | 485 |

In certain embodiments, a target region is nucleotides 88142-88269 of SEQ ID NO: 8. In certain embodiments, a short antisense compound is targeted to nucleotides 88142-88269 of SEQ ID NO: 8. In certain such embodiments, a short antisense compound targeted to nucleotides 88142-88269 comprises a nucleotide sequence selected from SEQ ID NO 413, 414, 415, 416, 417, or 418. In certain such embodiments, an antisense compound targeted to nucleotides 88142-88269 of SEQ ID NO: 8 is selected from Isis NO. 371644, 371645, 371649, 371651, 371652, or 371653.

In certain embodiments, a target region is nucleotides 88142-88169 of SEQ ID NO: 8. In certain embodiments, a short antisense compound is targeted to nucleotides 88142-88169 of SEQ ID NO: 8. In certain such embodiments, a short antisense compound targeted to nucleotides 88142-88169 comprises a nucleotide sequence selected from SEQ ID NO 413 or 414. In certain such embodiments, an antisense compound targeted to nucleotides 88142-88169 of SEQ ID NO: 8 is selected from Isis NO. 371644 or 371645.

In certain embodiments, a target region is nucleotides 88242-88269 of SEQ ID NO: 8. In certain embodiments, a short antisense compound is targeted to nucleotides 88242-88269 of SEQ ID NO: 8. In certain such embodiments, a short antisense compound targeted to nucleotides 88242-88269 comprises a nucleotide sequence selected from SEQ ID NO 416, 417, or 418. In certain such embodiments, an antisense compound targeted to nucleotides 88242-88269 of SEQ ID NO: 8 is selected from Isis NO. 371651, 371652, or 371653.

In certain embodiments, a target region is nucleotides 92037-92155 of SEQ ID NO: 8. In certain embodiments, a short antisense compound is targeted to nucleotides 92037-92155 of SEQ ID NO: 8. In certain such embodiments, a short antisense compound targeted to nucleotides 92037-92155 comprises a nucleotide sequence selected from SEQ ID NO 419, 420, 421, or 422. In certain such embodiments, an antisense compound targeted to nucleotides 92037-92155 of SEQ ID NO: 8 is selected from Isis NO. 371665, 371669, 371671, or 171673.

In certain embodiments, a target region is nucleotides 92114-92155 of SEQ ID NO: 8. In certain embodiments, a short antisense compound is targeted to nucleotides 92114-92155 of SEQ ID NO: 8. In certain such embodiments, a short antisense compound targeted to nucleotides 92114-92155 comprises a nucleotide sequence selected from SEQ ID NO 421 or 422. In certain such embodiments, an antisense compound targeted to nucleotides 92114-92155 of SEQ ID NO: 8 is selected from Isis NO. 371671 or 171673.

In certain embodiments, short antisense compounds targeted to a GCCR nucleic acid are 8 to 16, preferably 9 to 15, more preferably 9 to 14, more preferably 10 to 14 nucleotides in length. In certain embodiments, short antisense compounds targeted to a GCCR nucleic acid are 9 to 14 nucleotides in length. In certain embodiments, short antisense compounds targeted to a GCCR nucleic acid are 10 to 14 nucleotides in length. In certain embodiments, such short antisense compounds are short antisense oligonucleotides.

In certain embodiments, short antisense compounds targeted to a GCCR nucleic acid are short gapmers. In certain such embodiments, short gapmers targeted to a GCCR nucleic acid comprise at least one high affinity modification in one or more wings of the compound. In certain embodiments, short antisense compounds targeted to a GCCR nucleic acid comprise 1 to 3 high-affinity modifications in each wing. In certain such embodiments, the nucleosides or nucleotides of the wing comprise a 2' modification. In certain such embodiments, the monomers of the wing are BNA's. In certain such embodiments, the monomers of the wing are selected from α-L-Methyleneoxy (4'-CH$_2$—O-2') BNA, β-D-Methyleneoxy (4'-CH$_2$—O-2') BNA, Ethyleneoxy (4'-(CH$_2$)$_2$—O-2') BNA, Aminooxy (4'-CH$_2$—O—N(R)-2') BNA and Oxyamino (4'-CH$_2$—N(R)—O-2') BNA. In certain embodiments, the monomers of a wing comprise a substituent at the 2' position selected from allyl, amino, azido, thio, O-allyl, O—C$_1$-C$_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), and O—CH$_2$—C(=O)—N(R$_m$)(R$_n$), where each R$_m$ and R$_n$ is, independently, H or substituted or unsubstituted C$_1$-C$_{10}$ alkyl. In certain embodiments, the monomers of a wing are 2'MOE nucleotides.

In certain embodiments, short antisense compounds targeted to a GCCR nucleic acid comprise a gap between the 5' wing and the 3' wing. In certain embodiments the gap comprises five, six, seven, eight, nine, ten, eleven, twelve, thirteen, or fourteen monomers. In certain embodiments, the monomers of the gap are unmodified deoxyribonucleotides. In certain embodiments, the monomers of the gap are unmodified ribonucleotides. In certain embodiments, gap modifications (if any) gap result in an antisense compound that, when bound to its target nucleic acid, supports cleavage by an RNase, including, but not limited to, RNase H.

In certain embodiments, short antisense compounds targeted to a GCCR nucleic acid have uniform monomeric linkages. In certain such embodiments, those linkages are all phosphorothioate linkages. In certain embodiments, the linkages are all phosphodiester linkages. In certain embodiments, short antisense compounds targeted to a GCCR nucleic acid have mixed backbones.

In certain embodiments, short antisense compounds targeted to a GCCR nucleic acid are 8 monomers in length. In certain embodiments, short antisense compounds targeted to a GCCR nucleic acid are 9 monomers in length. In certain embodiments, short antisense compounds targeted to a GCCR nucleic acid are 10 monomers in length. In certain embodiments, short antisense compounds targeted to a GCCR nucleic acid are 11 monomers in length. In certain embodiments, short antisense compounds targeted to a GCCR nucleic acid are monomers in length. In certain embodiments, short antisense compounds targeted to a GCCR nucleic acid are 13 monomers in length. In certain embodiments, short antisense compounds targeted to a GCCR nucleic acid are 14 monomers in length. In certain embodiments, short antisense compounds targeted to a GCCR nucleic acid are 15 monomers in length. In certain embodiments, short antisense compounds targeted to a GCCR nucleic acid are 16 monomers in length. In certain embodiments, short antisense compounds targeted to a GCCR nucleic acid comprise 9 to 15 monomers. In certain embodiments, short antisense compounds targeted to a GCCR nucleic acid comprise 10 to 15 monomers. In certain embodiments, short antisense compounds targeted to a GCCR nucleic acid comprise 12 to 14 monomers. In certain embodiments, short antisense compounds targeted to a GCCR nucleic acid comprise 12 to 14 nucleotides or nucleosides.

In certain embodiments, the invention provides methods of modulating expression of GCCR. In certain embodiments, such methods comprise use of one or more short antisense compound targeted to a GCCR nucleic acid, wherein the short antisense compound targeted to a GCCR nucleic acid is from about 8 to about 16, preferably 9 to 15, more preferably 9 to 14, more preferably 10 to 14 monomers (i.e. from about 8 to about 16 linked monomers). One of ordinary skill in the art will appreciate that this comprehends methods of modulating expression of GCCR using one or more short antisense compounds targeted to a GCCR nucleic acid of 8, 9, 10, 11, 12, 13, 14, 15 or 16 monomers.

In certain embodiments, methods of modulating GCCR comprise use of a short antisense compound targeted to a GCCR nucleic acid that is 8 monomers in length. In certain embodiments, methods of modulating GCCR comprise use of a short antisense compound targeted to a GCCR nucleic acid that is 9 monomers in length. In certain embodiments, methods of modulating GCCR comprise use of a short antisense compound targeted to a GCCR nucleic acid that is 10 monomers in length. In certain embodiments, methods of modulating GCCR comprise use of a short antisense compound targeted to a GCCR nucleic acid that is 11 monomers in length. In certain embodiments, methods of modulating GCCR comprise use of a short antisense compound targeted to a GCCR nucleic acid that is 12 monomers in length. In certain embodiments, methods of modulating GCCR comprise use of a short antisense compound targeted to a GCCR nucleic acid that is 13 monomers in length. In certain embodiments, methods of modulating GCCR comprise use of a short antisense compound targeted to a GCCR nucleic acid that is 14 monomers in length. In certain embodiments, methods of modulating GCCR comprise use of a short antisense compound targeted to a GCCR nucleic acid that is 15 monomers in length. In certain embodiments, methods of modulating GCCR comprise use of a short antisense compound targeted to a GCCR nucleic acid that is 16 monomers in length.

In certain embodiments, methods of modulating expression of GCCR comprise use of a short antisense compound targeted to a GCCR nucleic acid comprising 9 to 15 monomers. In certain embodiments, methods of modulating expression of GCCR comprise use of a short antisense compound targeted to a GCCR nucleic acid comprising 10 to 15 monomers. In certain embodiments, methods of modulating expression of GCCR comprise use of a short antisense compound targeted to a GCCR nucleic acid comprising 12 to 14 monomers. In certain embodiments, methods of modulating expression of GCCR comprise use of a short antisense compound targeted to a GCCR nucleic acid comprising 12 or 14 nucleotides or nucleosides.

7. Glucagon Receptor (GCGR)

The maintenance of normal glycemia is a carefully regulated metabolic event. Glucagon, the 29-amino acid peptide responsible for maintaining blood glucose levels in the postabsorbative state, increases glucose release from the liver by activating hepatic glycogenolysis, gluconeogenesis, stimulating lipolysis in adipose tissue, and stimulating insulin secretion. During high blood glucose levels, insulin reverses the glucagon-mediated enhancement of glycogenolysis and gluconeogenesis. In patients with diabetes, insulin is either not available or not fully effective. While treatment for diabetes has traditionally focused on increasing insulin levels, antagonism of glucagon function has been considered as an alternative therapy. As glucagon exerts its physiological effects by signaling through the glucagon receptor, the glucagon receptor has been proposed as a potential therapeutic target for diabetes (Madsen et al., Curr. Pharm. Des., 1999, 5, 683-691).

Glucagon receptor is belongs to the superfamily of G-protein-coupled receptors having seven transmembrane domains. It is also a member of the smaller sub-family of homologous receptors which bind peptides that are structurally similar to glucagon. The gene encoding human glucagon receptor was cloned in 1994 and analysis of the genomic sequence revealed multiple introns and an 82% identity to the rat glucagon receptor gene (Lok et al., Gene, 1994, 140, 203-209; MacNeil et al., Biochem. Biophys. Res. Commun., 1994, 198, 328-334). Cloning of the rat glucagon receptor gene also led to the description of multiple alternative splice variants (Maget et al., FEBS Lett., 1994, 351, 271-275). The human glucagon receptor gene is localized to chromosome 17q25 (Menzel et al., Genomics, 1994, 20, 327-328). A missense mutation of Gly to Ser at codon 40 in the glucagon receptor gene leads to a 3-fold lower affinity for glucagon (Fujisawa et al., Diabetologia, 1995, 38, 983-985) and this mutation has been linked to several disease states, including non-insulin-dependent diabetes mellitus (Fujisawa et al., Diabetologia, 1995, 38, 983-985), hypertension (Chambers and Morris, Nat. Genet., 1996, 12, 122), and central adiposity (Siani et al., Obes. Res., 2001, 9, 722-726).

Definitions

"Glucagon receptor" is the gene product or protein of which expression is to be modulated by administration of a short antisense compound. Glucagon receptor is generally referred to as GCGR but may also be referred to as GR, GGR, MGC138246, MGC93090.

"GCGR nucleic acid" means any nucleic acid encoding GCGR. For example, in certain embodiments, a GCGR nucleic acid includes, without limitation, a GCGR sequence encoding GCGR, an RNA sequence transcribed from DNA encoding GCGR, and an mRNA sequence encoding GCGR. "GCGR mRNA" means an mRNA encoding a GCGR protein.

Therapeutic Indications

Antisense technology is an effective means for reducing glucagon receptor (GCGR) expression and has proven to be uniquely useful in a number of therapeutic, diagnostic, and research applications. As such, in certain embodiments, the present invention provides short antisense compounds targeted to a nucleic acid encoding glucagon receptor, and which modulate the expression of glucagon receptor. Further provided herein are short antisense compounds capable of inhibiting GCGR expression. Also provided herein are methods of treating an individual comprising administering one or more pharmaceutical compositions comprising a short antisense compound targeted to a GCGR nucleic acid. In certain embodiments, because short antisense compounds targeted to a GCGR nucleic acid inhibit GCGR expression, provided herein are methods of treating a subject having a disease or condition associated with GCGR activity by administering one or more pharmaceutical compositions comprising a short antisense compound targeted to a GCGR nucleic acid. For example, provided herein are methods of treating a subject having high blood glucose, hyperglycemia, prediabetes, diabetes, Type 2 diabetes, metabolic syndrome, obesity and/or insulin resistance.

Also contemplated herein are pharmaceutical composition comprising one or more short antisense compounds targeted to GCGR and optionally a pharmaceutically acceptable carrier, diluent, enhancer or excipient. Certain compounds of the invention can also be used in the manufacture of a medicament for the treatment of diseases and disorders related to glucagon effects mediated by GCGR.

Certain embodiments of the present invention include methods of reducing the expression of GCGR in tissues or cells comprising contacting said cells or tissues with a short antisense compound targeted to a nucleic acid encoding GCGR or pharmaceutical composition comprising such a short antisense compound. In certain such embodiments, the invention provides methods of decreasing blood glucose levels, blood triglyceride levels, or blood cholesterol levels in a subject comprising administering to the subject a short antisense compound or a pharmaceutical composition. Blood levels may be plasma levels or serum levels. Also contemplated are methods of improving insulin sensitivity, methods of increasing GLP-1 levels and methods of inhibiting hepatic glucose output in an animal comprising administering to said animal an antisense oligonucleotide or a pharmaceutical composition of the invention. An improvement in insulin sensitivity may be indicated by a reduction in circulating insulin levels.

In certain embodiments, the invention provides methods of treating a subject having a disease or condition associated with glucagon activity via GCGR comprising administering to the subject a therapeutically or prophylactically effective amount of a short antisense compound or a pharmaceutical composition. In certain embodiments, such disease or condition may be a metabolic disease or condition. In certain embodiments, the metabolic disease or condition is diabetes, hyperglycemia, hyperlipidemia, metabolic syndrome X, obesity, primary hyperglucagonemia, insulin deficiency, or insulin resistance. In some embodiments, the diabetes is Type 2 diabetes. In some embodiments the obesity is diet-induced. In some embodiments, hyperlipidemia is associated with elevated blood lipid levels. Lipids include cholesterol and triglycerides. In one embodiment, the condition is liver steatosis. In some embodiments, the steatosis is steatohepatitis or non-alcoholic steatohepatitis.

In certain embodiments, the invention provides methods of preventing or delaying the onset of elevated blood glucose levels in an animal as well as methods of preserving beta-cell function in an animal using the oligomeric compounds delineated herein.

Certain short antisense compounds targeted to GCGR can be used to modulate the expression of GCGR in a subject in need thereof, such as an animal, including, but not limited to, a human In certain embodiments, such methods comprise the step of administering to said animal an effective amount of a short antisense compound that reduces expression of GCGR RNA. In certain embodiments, short antisense compounds effectively reduce the levels or function of GCGR RNA. Because reduction in GCGR mRNA levels can lead to alteration in GCGR protein products of expression as well, such resultant alterations can also be measured. Certain antisense compounds that effectively reduce the levels or function of GCGR RNA or protein products of expression is considered an active antisense compound. In certain embodiments, short antisense compounds reduce the expression of GCGR causing a reduction of RNA by at least 10%, by at least 20%, by at least 25%, by at least 30%, by at least 40%, by at least 50%, by at least 60%, by at least 70%, by at least 75%, by at least 80%, by at least 85%, by at least 90%, by at least 95%, by at least 98%, by at least 99%, or by 100%.

Further provided are methods of screening for modulators of glucagon receptor and methods of modulating the expression of glucagon receptor in cells, tissues or animals comprising contacting said cells, tissues or animals with one or more short antisense compounds targeted to GCGR or with compositions comprising such compounds. Methods of treating an animal, particularly a human, suspected of having or being prone to a disease or condition associated with expression of glucagon receptor are also set forth herein. Certain such methods comprise administering a therapeutically or prophylactically effective amount of one or more of the compounds or compositions of the invention to the person in need of treatment.

The reduction of the expression of glucagon receptor may be measured, for example, in blood, plasma, serum, adipose tissue, liver or any other body fluid, tissue or organ of the animal. Preferably, the cells contained within said fluids, tissues or organs being analyzed contain a nucleic acid molecule encoding glucagon receptor protein and/or the glucagon receptor protein itself.

Pharmaceutical and other compositions comprising short antisense compounds are also provided. In certain embodiments short antisense compounds targeted to a nucleic acid encoding GCGR are utilized in pharmaceutical compositions by adding an effective amount of a compound to a suitable pharmaceutically acceptable diluent or carrier.

The short antisense compounds targeting a GCGR nucleic acid may have any one or more properties or characteristics of the short antisense compounds generally described herein. In certain embodiments, short antisense compounds targeting a GCGR nucleic acid have a motif (wing-deoxy gap-wing) selected from 1-12-1, 1-1-10-2, 2-10-1-1, 3-10-3, 2-10-3, 2-10-2, 1-10-1, 1-10-2, 3-8-3, 2-8-2, 1-8-1, 3-6-3 or 1-6-1. In certain embodiments, short antisense compounds targeting a GCGR nucleic acid have a motif (wing-deoxy gap-wing) selected from 1-12-1, 2-10-2, 3-10-3, 3-8-3, 1-1-10-2.

Certain Short Antisense Compounds Targeted to a GCGR Nucleic Acid

In certain embodiments, short antisense compounds are targeted to a GCGR nucleic acid having the sequence GENBANK® Accession No. NM_000160.1, incorporated herein as SEQ ID NO: 9. In certain such embodiments, a short antisense compound targeted to SEQ ID NO: 9 is at least 90% complementary to SEQ ID NO: 9. In certain such embodiments, a short antisense compound targeted to SEQ ID NO: 9 is at least 95% complementary to SEQ ID NO: 9. In certain such embodiments, a short antisense compound targeted to SEQ ID NO: 9 is 100% complementary to SEQ ID NO: 9. In certain embodiments, a short antisense compound targeted to SEQ ID NO: 9 includes a nucleotide sequence selected from the nucleotide sequences set forth in Tables 12 and 13.

The nucleotide sequences set forth in each SEQ ID NO in Tables 12 and 13 are independent of any modification to a sugar moiety, an internucleoside linkage, or a nucleobase. As such, short antisense compounds defined by a SEQ ID NO may comprise, independently, one or more modifications to a sugar moiety, an internucleoside linkage, or a nucleobase. Short antisense compounds described by Isis Number (Isis NO.) indicate a combination of nucleobase sequence and one or more modifications to a sugar moiety, an internucleoside linkage, or a nucleobase.

In certain embodiments, short antisense compounds targeted to a GCCR nucleic acid comprise a gapmer motif. In certain embodiments, a short antisense compound targeted to a GCCR nucleic acid comprises a 3-10-3 gapmer motif. In certain embodiments, short antisense compounds targeted to a GCCR nucleic acid comprise a gapmer motif. In certain embodiments, a short antisense compound targeted to a GCCR nucleic acid comprises a 3-8-3 gapmer motif. In certain embodiments, short antisense compounds targeted to a GCCR nucleic acid comprise a gapmer motif. In certain embodiments, a short antisense compound targeted to a GCCR nucleic acid comprises a 2-10-2 gapmer motif.

Tables 12 and 13 illustrate examples of short antisense compounds targeted to SEQ ID NO: 9. Table 12 illustrates short antisense compounds that are 100% complementary to SEQ ID NO: 9. Table 13 illustrates short antisense compounds that have one or two mismatches with respect to SEQ ID NO: 9. The column labeled 'gapmer motif' indicates the wing-gap-wing motif of each short antisense compounds. The gap segment comprises 2'-deoxynucleotides and each nucleotide of each wing segment comprises a 2'-modified sugar. The particular 2'-modified sugar is also indicated in the 'gapmer motif' column. For example, '2-10-2 MOE' means a 2-10-2 gapmer motif, where a gap segment of ten 2'-deoxynucleotides is flanked by wing segments of two nucleotides, where the nucleotides of the wing segments are 2'-MOE nucleotides. Internucleoside linkages are phosphorothioate. The short antisense compounds comprise 5-methylcytidine in place of unmodified cytosine, unless "unmodified cytosine" is listed in the gapmer motif column, in which case the indicated cytosines are unmodified cytosines. For example, "5-mC in gap only" indicates that the gap segment has 5-methylcytosines, while the wing segments have unmodified cytosines.

TABLE 12

Short Antisense Compounds targeted to SEQ ID NO: 9

| ISIS NO. | 5' Target Site | 3' Target Site | Sequence (5'-3') | Gapmer Motif | SEQ ID NO |
|---|---|---|---|---|---|
| 338463 | 378 | 393 | TAGAGCTTCCACTTCT | 3-10-3 MOE | 486 |
| 338534 | 378 | 391 | GAGCTTCCACTTCT | 3-8-3 MOE | 487 |
| 327130 | 499 | 512 | TGTTGGCCGTGGTA | 3-8-3 MOE | 488 |
| 327131 | 500 | 513 | ATGTTGGCCGTGGT | 3-8-3 MOE | 489 |
| 327132 | 501 | 514 | GATGTTGGCCGTGG | 3-8-3 MOE | 490 |
| 327133 | 502 | 515 | AGATGTTGGCCGTG | 3-8-3 MOE | 491 |
| 327134 | 503 | 516 | GAGATGTTGGCCGT | 3-8-3 MOE | 492 |
| 327135 | 504 | 517 | GGAGATGTTGGCCG | 3-8-3 MOE | 493 |
| 327136 | 505 | 518 | AGGAGATGTTGGCC | 3-8-3 MOE | 494 |
| 327137 | 506 | 519 | CAGGAGATGTTGGC | 3-8-3 MOE | 495 |
| 327138 | 507 | 520 | GCAGGAGATGTTGG | 3-8-3 MOE | 496 |
| 327139 | 508 | 521 | GGCAGGAGATGTTG | 3-8-3 MOE | 497 |
| 327140 | 531 | 544 | GTGGTGCCAAGGCA | 3-8-3 MOE | 498 |
| 327141 | 532 | 545 | TGTGGTGCCAAGGC | 3-8-3 MOE | 499 |
| 327142 | 533 | 546 | TTGTGGTGCCAAGG | 3-8-3 MOE | 500 |
| 327143 | 534 | 547 | TTTGTGGTGCCAAG | 3-8-3 MOE | 501 |
| 327144 | 535 | 548 | CTTTGTGGTGCCAA | 3-8-3 MOE | 502 |
| 327145 | 536 | 549 | ACTTTGTGGTGCCA | 3-8-3 MOE | 503 |
| 327146 | 537 | 550 | CACTTTGTGGTGCC | 3-8-3 MOE | 504 |
| 327147 | 538 | 551 | GCACTTTGTGGTGC | 3-8-3 MOE | 505 |
| 327148 | 539 | 552 | TGCACTTTGTGGTG | 3-8-3 MOE | 506 |
| 327149 | 540 | 553 | TTGCACTTTGTGGT | 3-8-3 MOE | 507 |
| 327150 | 545 | 558 | CGGTGTTGCACTTT | 3-8-3 MOE | 508 |
| 327151 | 546 | 559 | GCGGTGTTGCACTT | 3-8-3 MOE | 509 |
| 327152 | 547 | 560 | AGCGGTGTTGCACT | 3-8-3 MOE | 510 |
| 327153 | 548 | 561 | AAGCGGTGTTGCAC | 3-8-3 MOE | 511 |
| 327154 | 549 | 562 | GAAGCGGTGTTGCA | 3-8-3 MOE | 512 |
| 327155 | 550 | 563 | CGAAGCGGTGTTGC | 3-8-3 MOE | 513 |
| 327156 | 551 | 564 | ACGAAGCGGTGTTG | 3-8-3 MOE | 514 |
| 327157 | 552 | 565 | CACGAAGCGGTGTT | 3-8-3 MOE | 515 |
| 327158 | 553 | 566 | ACACGAAGCGGTGT | 3-8-3 MOE | 516 |
| 327159 | 554 | 567 | AACACGAAGCGGTG | 3-8-3 MOE | 517 |
| 345897 | 684 | 697 | GCTGCTGTACATCT | 2-10-2 MOE | 518 |
| 327160 | 684 | 697 | GCTGCTGTACATCT | 3-8-3 MOE | 518 |
| 327161 | 685 | 698 | AGCTGCTGTACATC | 3-8-3 MOE | 520 |
| 327162 | 686 | 699 | AAGCTGCTGTACAT | 3-8-3 MOE | 521 |
| 327163 | 687 | 700 | GAAGCTGCTGTACA | 3-8-3 MOE | 522 |
| 327164 | 688 | 701 | GGAAGCTGCTGTAC | 3-8-3 MOE | 523 |
| 327165 | 689 | 702 | TGGAAGCTGCTGTA | 3-8-3 MOE | 524 |
| 327166 | 690 | 703 | CTGGAAGCTGCTGT | 3-8-3 MOE | 525 |
| 327167 | 691 | 704 | CCTGGAAGCTGCTG | 3-8-3 MOE | 526 |
| 327168 | 692 | 705 | ACCTGGAAGCTGCT | 3-8-3 MOE | 527 |
| 327169 | 693 | 706 | CACCTGGAAGCTGC | 3-8-3 MOE | 528 |
| 327170 | 694 | 707 | TCACCTGGAAGCTG | 3-8-3 MOE | 529 |
| 327171 | 695 | 708 | ATCACCTGGAAGCT | 3-8-3 MOE | 530 |
| 327172 | 696 | 709 | CATCACCTGGAAGC | 3-8-3 MOE | 531 |
| 327173 | 697 | 710 | ACATCACCTGGAAG | 3-8-3 MOE | 532 |
| 327174 | 698 | 711 | TACATCACCTGGAA | 3-8-3 MOE | 533 |
| 327175 | 699 | 712 | GTACATCACCTGGA | 3-8-3 MOE | 534 |
| 327176 | 700 | 713 | TGTACATCACCTGG | 3-8-3 MOE | 535 |
| 327177 | 701 | 714 | GTGTACATCACCTG | 3-8-3 MOE | 536 |
| 327178 | 869 | 882 | TAGCGGGTCCTGAG | 3-8-3 MOE | 537 |
| 327179 | 870 | 883 | GTAGCGGGTCCTGA | 3-8-3 MOE | 538 |
| 327180 | 871 | 884 | TGTAGCGGGTCCTG | 3-8-3 MOE | 539 |
| 327181 | 872 | 885 | CTGTAGCGGGTCCT | 3-8-3 MOE | 540 |
| 327182 | 873 | 886 | GCTGTAGCGGGTCC | 3-8-3 MOE | 541 |
| 327183 | 874 | 887 | GGCTGTAGCGGGTC | 3-8-3 MOE | 542 |
| 327184 | 875 | 888 | TGGCTGTAGCGGGT | 3-8-3 MOE | 543 |
| 327185 | 876 | 889 | CTGGCTGTAGCGGG | 3-8-3 MOE | 544 |
| 327186 | 877 | 890 | TCTGGCTGTAGCGG | 3-8-3 MOE | 545 |
| 327187 | 878 | 891 | TTCTGGCTGTAGCG | 3-8-3 MOE | 546 |
| 327188 | 955 | 968 | TGAACACCGCGGCC | 3-8-3 MOE | 547 |
| 327189 | 956 | 969 | ATGAACACCGCGGC | 3-8-3 MOE | 548 |
| 327190 | 957 | 970 | CATGAACACCGCGG | 3-8-3 MOE | 549 |
| 327191 | 958 | 971 | GCATGAACACCGCG | 3-8-3 MOE | 550 |
| 327192 | 959 | 972 | TGCATGAACACCGC | 3-8-3 MOE | 551 |
| 327193 | 960 | 973 | TTGCATGAACACCG | 3-8-3 MOE | 552 |
| 327194 | 961 | 974 | ATTGCATGAACACC | 3-8-3 MOE | 553 |
| 327195 | 962 | 975 | TATTGCATGAACAC | 3-8-3 MOE | 554 |
| 327196 | 963 | 976 | ATATTGCATGAACA | 3-8-3 MOE | 555 |
| 327197 | 964 | 977 | CATATTGCATGAAC | 3-8-3 MOE | 556 |
| 327198 | 1019 | 1032 | AGGTTGTGCAGGTA | 3-8-3 MOE | 557 |
| 327199 | 1020 | 1033 | CAGGTTGTGCAGGT | 3-8-3 MOE | 558 |

TABLE 12-continued

Short Antisense Compounds targeted to SEQ ID NO: 9

| ISIS NO. | 5' Target Site | 3' Target Site | Sequence (5'-3') | Gapmer Motif | SEQ ID NO |
|---|---|---|---|---|---|
| 327200 | 1021 | 1034 | GCAGGTTGTGCAGG | 3-8-3 MOE | 559 |
| 327201 | 1022 | 1035 | AGCAGGTTGTGCAG | 3-8-3 MOE | 560 |
| 327202 | 1023 | 1036 | CAGCAGGTTGTGCA | 3-8-3 MOE | 561 |
| 327203 | 1024 | 1037 | CCAGCAGGTTGTGC | 3-8-3 MOE | 562 |
| 327204 | 1025 | 1038 | CCCAGCAGGTTGTG | 3-8-3 MOE | 563 |
| 327205 | 1026 | 1039 | GCCCAGCAGGTTGT | 3-8-3 MOE | 564 |
| 327206 | 1027 | 1040 | GGCCCAGCAGGTTG | 3-8-3 MOE | 565 |
| 327207 | 1028 | 1041 | AGGCCCAGCAGGTT | 3-8-3 MOE | 566 |
| 338491 | 1160 | 1175 | TGTCATTGCTGGTCCA | 3-10-3 MOE | 567 |
| 338562 | 1160 | 1173 | TCATTGCTGGTCCA | 3-8-3 MOE | 568 |
| 338498 | 1307 | 1322 | TGGCCAGCCGGAACTT | 3-10-3 MOE | 569 |
| 338569 | 1307 | 1320 | GCCAGCCGGAACTT | 3-8-3 MOE | 570 |
| 338499 | 1329 | 1344 | GGGATGAGGGTCAGCG | 3-10-3 MOE | 571 |
| 338570 | 1329 | 1342 | GATGAGGGTCAGCG | 3-8-3 MOE | 572 |
| 385067 | 1364 | 1377 | AAGGCAAAGACCAC | 3-8-3 MOE | 573 |
| 338573 | 1401 | 1414 | GGAGCGCAGGGTGC | 3-8-3 MOE | 574 |
| 338580 | 1487 | 1500 | TGCACCTCCTTGTT | 3-8-3 MOE | 575 |

TABLE 13

Short antisense compounds targeted to SEQ ID NO: 1 and having 1 or 2 mismatches

| ISIS NO. | 5' Target Site | 3' Target Site | Sequence (5'-3') | Gapmer Motif | SEQ ID NO |
|---|---|---|---|---|---|
| 338577 | 158 | 171 | CAGCAGACCCTGGA | 3-8-3 MOE | 576 |
| 338458 | 237 | 252 | ACATCTGGCAGAGGTT | 3-10-3 MOE | 577 |
| 338529 | 237 | 250 | ATCTGGCAGAGGTT | 3-8-3 MOE | 578 |
| 338466 | 318 | 333 | CAGGCCAGCAGGAGTA | 3-10-3 MOE | 579 |
| 338537 | 318 | 331 | GGCCAGCAGGAGTA | 3-8-3 MOE | 580 |
| 338533 | 364 | 377 | CAAACAAAAGTCC | 3-8-3 MOE | 582 |
| 338462 | 364 | 379 | CTCAAACAAAAGTCC | 3-10-3 MOE | 581 |
| 338535 | 397 | 410 | GGTGACATTGGTCA | 3-8-3 MOE | 584 |
| 338464 | 397 | 412 | GTGGTGACATTGGTCA | 3-10-3 MOE | 583 |
| 338466 | 470 | 485 | CAGGCCAGCAGGAGTA | 3-10-3 MOE | 579 |
| 338537 | 470 | 483 | GGCCAGCAGGAGTA | 3-8-3 MOE | 580 |
| 385048 | 497 | 510 | TTGGCAGTGGTGTT | 3-8-3 MOE | 587 |
| 385049 | 500 | 513 | ATGTTGGCAGTGGT | 3-8-3 MOE | 588 |
| 338467 | 503 | 518 | AGGAAATGTTGGCAGT | 3-10-3 MOE | 589 |
| 338538 | 503 | 516 | GAAATGTTGGCAGT | 3-8-3 MOE | 590 |
| 385050 | 506 | 519 | CAGGAAATGTTGGC | 3-8-3 MOE | 591 |
| 385051 | 509 | 522 | GGGCAGGAAATGTT | 3-8-3 MOE | 592 |
| 385052 | 523 | 536 | AAGGTAGGTACCAG | 3-8-3 MOE | 593 |
| 385053 | 526 | 539 | ACCAAGGTAGGTAC | 3-8-3 MOE | 594 |
| 385056 | 535 | 548 | CTTTGTGGCACCAA | 3-8-3 MOE | 595 |
| 385057 | 538 | 551 | GCACTTTGTGGCAC | 3-8-3 MOE | 596 |
| 338539 | 539 | 552 | TGCACTTTGTGGCA | 3-8-3 MOE | 597 |

TABLE 13-continued

Short antisense compounds targeted to SEQ
ID NO: 1 and having 1 or 2 mismatches

| ISIS NO. | 5' Target Site | 3' Target Site | Sequence (5'-3') | Gapmer Motif | SEQ ID NO |
|---|---|---|---|---|---|
| 385058 | 541 | 554 | GCTGCACTTTGTGG | 3-8-3 MOE | 598 |
| 385059 | 544 | 557 | GGTGCTGCACTTTG | 3-8-3 MOE | 599 |
| 385060 | 547 | 560 | GGCGGTGCTGCACT | 3-8-3 MOE | 600 |
| 385063 | 556 | 569 | TGAACACTAGGCGG | 3-8-3 MOE | 601 |
| 385064 | 559 | 572 | TCTTGAACACTAGG | 3-8-3 MOE | 602 |
| 338469 | 561 | 576 | CACCTCTTGAACACTA | 3-10-3 MOE | 603 |
| 338540 | 561 | 574 | CCTCTTGAACACTA | 3-8-3 MOE | 604 |
| 385065 | 562 | 575 | ACCTCTTGAACACT | 3-8-3 MOE | 605 |
| 385066 | 565 | 578 | CACACCTCTTGAAC | 3-8-3 MOE | 606 |
| 338541 | 590 | 603 | CCTCGAACCCACTG | 3-8-3 MOE | 607 |
| 338473 | 658 | 673 | CTTCTGGACCTCGATC | 3-10-3 MOE | 608 |
| 338544 | 658 | 671 | TCTGGACCTCGATC | 3-8-3 MOE | 609 |
| 338474 | 681 | 696 | CTGCTATACATCTTGG | 3-10-3 MOE | 610 |
| 338545 | 681 | 694 | GCTATACATCTTGG | 3-8-3 MOE | 611 |
| 338475 | 703 | 718 | CACGGTGTACATCACC | 3-10-3 MOE | 612 |
| 338546 | 703 | 716 | CGGTGTACATCACC | 3-8-3 MOE | 613 |
| 338547 | 718 | 731 | ACAGACTGTAGCCC | 3-8-3 MOE | 615 |
| 338476 | 718 | 733 | GGACAGACTGTAGCCC | 3-10-3 MOE | 614 |
| 338550 | 889 | 902 | CATCGCCAATCTTC | 3-8-3 MOE | 617 |
| 338479 | 889 | 904 | GTCATCGCCAATCTTC | 3-10-3 MOE | 616 |
| 338551 | 899 | 912 | ACACTGAGGTCATC | 3-8-3 MOE | 619 |
| 338480 | 899 | 914 | TCACACTGAGGTCATC | 3-10-3 MOE | 618 |
| 338552 | 924 | 937 | CGCCCCGTCACTGA | 3-8-3 MOE | 620 |
| 338555 | 992 | 1005 | AGCAACCAGCAATA | 3-8-3 MOE | 622 |
| 338484 | 992 | 1007 | CCAGCAACCAGCAATA | 3-10-3 MOE | 621 |
| 338485 | 1018 | 1033 | CAGGCTGTACAGGTAC | 3-10-3 MOE | 623 |
| 338556 | 1018 | 1031 | GGCTGTACAGGTAC | 3-8-3 MOE | 624 |
| 338558 | 1051 | 1064 | AGCTCCTCTCAGAG | 3-8-3 MOE | 626 |
| 338487 | 1051 | 1066 | GAAGCTCCTCTCAGAG | 3-10-3 MOE | 625 |
| 338559 | 1079 | 1092 | CAGCCAATGCCCAG | 3-8-3 MOE | 628 |
| 338488 | 1079 | 1094 | CCCAGCCAATGCCCAG | 3-10-3 MOE | 627 |
| 338560 | 1131 | 1144 | AAACAGACACTTGA | 3-8-3 MOE | 630 |
| 338489 | 1131 | 1146 | TCAAACAGACACTTGA | 3-10-3 MOE | 629 |
| 338490 | 1145 | 1160 | AGCACTGAACATTCTC | 3-10-3 MOE | 631 |
| 338561 | 1145 | 1158 | CACTGAACATTCTC | 3-8-3 MOE | 632 |
| 338563 | 1181 | 1194 | ATCCACCAGAATCC | 3-8-3 MOE | 634 |

TABLE 13-continued

Short antisense compounds targeted to SEQ
ID NO: 1 and having 1 or 2 mismatches

| ISIS NO. | 5' Target Site | 3' Target Site | Sequence (5'-3') | Gapmer Motif | SEQ ID NO |
|---|---|---|---|---|---|
| 338492 | 1181 | 1196 | GGATCCACCAGAATCC | 3-10-3 MOE | 633 |
| 338564 | 1216 | 1229 | TGATCAGTAAGGCC | 3-8-3 MOE | 635 |
| 338565 | 1232 | 1245 | ACAAAGATGAAAAA | 3-8-3 MOE | 637 |
| 338494 | 1232 | 1247 | GGACAAAGATGAAAAA | 3-10-3 MOE | 636 |
| 338566 | 1267 | 1280 | CACGCAGCTTGGCC | 3-8-3 MOE | 639 |
| 338495 | 1267 | 1282 | GGCACGCAGCTTGGCC | 3-10-3 MOE | 638 |
| 338571 | 1344 | 1357 | GACCCCCAGCAGAG | 3-8-3 MOE | 641 |
| 338500 | 1344 | 1359 | TGGACCCCCAGCAGAG | 3-10-3 MOE | 640 |
| 385068 | 1366 | 1379 | CAAAGGCAAAGACC | 3-8-3 MOE | 642 |
| 385069 | 1369 | 1382 | TCACAAAGGCAAAG | 3-8-3 MOE | 643 |
| 385070 | 1372 | 1385 | CAGTCACAAAGGCA | 3-8-3 MOE | 644 |
| 385071 | 1375 | 1388 | CGTCAGTCACAAAG | 3-8-3 MOE | 645 |
| 385072 | 1378 | 1391 | GCTCGTCAGTCACA | 3-8-3 MOE | 646 |
| 385073 | 1381 | 1394 | CATGCTCGTCAGTC | 3-8-3 MOE | 647 |
| 386608 | 1384 | 1397 | GGGCATGCTCGTCA | 1-12-1 MOE | 648 |
| 386593 | 1384 | 1397 | GGGCATGCTCGTCA | 2-10-2 MOE | 648 |
| 396146 | 1384 | 1397 | GGGCATGCTCGTCA | 2-10-2 MOE | 648 |
| 338572 | 1384 | 1397 | GGGCATGCTCGTCA | 3-8-3 MOE | 648 |
| 396149 | 1384 | 1397 | GGGCATGCTCGTCA | 1-1-10-2 2'-(butylacetamido)-palmitamide/OMe/OMe | 648 |
| 386627 | 1384 | 1397 | GGGCATGCTCGTCA | 2-10-2 Methyleneoxy BNA | 648 |
| 386610 | 1387 | 1400 | CTTGGGCATGCTCG | 1-12-1 MOE | 654 |
| 386595 | 1387 | 1400 | CTTGGGCATGCTCG | 2-10-2 MOE | 654 |
| 385074 | 1387 | 1400 | CTTGGGCATGCTCG | 3-8-3 MOE | 654 |
| 385075 | 1390 | 1403 | TGCCTTGGGCATGC | 3-8-3 MOE | 657 |
| 385076 | 1393 | 1406 | GGGTGCCTTGGGCA | 3-8-3 MOE | 648 |
| 385077 | 1396 | 1409 | GCAGGGTGCCTTGG | 3-8-3 MOE | 659 |
| 385078 | 1399 | 1412 | AGCGCAGGGTGCCT | 3-8-3 MOE | 660 |
| 338502 | 1401 | 1416 | GTGGAGCGCAGGGTGC | 3-10-3 MOE | 661 |
| 385079 | 1402 | 1415 | TGGAGCGCAGGGTG | 3-8-3 MOE | 662 |
| 385080 | 1405 | 1418 | TGGTGGAGCGCAGG | 3-8-3 MOE | 663 |
| 385081 | 1408 | 1421 | GCTTGGTGGAGCGC | 3-8-3 MOE | 664 |
| 385082 | 1411 | 1424 | AGAGCTTGGTGGAG | 3-8-3 MOE | 665 |
| 338503 | 1412 | 1427 | AAAGAGCTTGGTGGA | 3-10-3 MOE | 666 |
| 338574 | 1412 | 1425 | AAGAGCTTGGTGGA | 3-8-3 MOE | 667 |

TABLE 13-continued

Short antisense compounds targeted to SEQ
ID NO: 1 and having 1 or 2 mismatches

| ISIS NO. | 5' Target Site | 3' Target Site | Sequence (5'-3') | Gapmer Motif | SEQ ID NO |
|---|---|---|---|---|---|
| 385083 | 1414 | 1427 | AAAAGAGCTTGGTG | 3-8-3 MOE | 668 |
| 385084 | 1417 | 1430 | CAAAAAGAGCTTG | 3-8-3 MOE | 669 |
| 338504 | 1434 | 1449 | AAGGAGCTGAGGAACA | 3-10-3 MOE | 670 |
| 338575 | 1434 | 1447 | GGAGCTGAGGAACA | 3-8-3 MOE | 671 |
| 327167 | 1441 | 1454 | CCTGGAAGCTGCTG | 3-8-3 MOE | 526 |
| 338576 | 1445 | 1458 | AGACCCTGGAAGGA | 3-8-3 MOE | 673 |
| 338505 | 1445 | 1460 | GCAGACCCTGGAAGGA | 3-10-3 MOE | 672 |
| 338506 | 1449 | 1464 | ACCAGCAGACCCTGGA | 3-10-3 MOE | 674 |
| 338577 | 1449 | 1462 | CAGCAGACCCTGGA | 3-8-3 MOE | 576 |
| 338507 | 1464 | 1479 | CAGTAGAGAACAGCCA | 3-10-3 MOE | 676 |
| 338578 | 1464 | 1477 | GTAGAGAACAGCCA | 3-8-3 MOE | 677 |
| 338508 | 1475 | 1490 | TGTTGAGGAAACAGTA | 3-10-3 MOE | 678 |
| 338579 | 1475 | 1488 | TTGAGGAAACAGTA | 3-8-3 MOE | 679 |
| 338509 | 1487 | 1502 | CCTGCACCTCCTTGTT | 3-10-3 MOE | 680 |
| 338580 | 1610 | 1623 | TGCACCTCCTTGTT | 3-8-3 MOE | 575 |

In certain embodiments, a target region is nucleotides 378-391 of SEQ ID NO: 9. In certain embodiments, a short antisense compound is targeted to nucleotides 378-391 of SEQ ID NO: 9. In certain such embodiments, a short antisense compound targeted to nucleotides 378-391 comprises a nucleotide sequence selected from SEQ ID NO 486 or 487. In certain such embodiments, a short antisense compound targeted to nucleotides 378-391 of SEQ ID NO: 9 is selected from Isis No 338463 or 338534.

In certain embodiments, a target region is nucleotides 499-521 of SEQ ID NO: 9. In certain embodiments, a short antisense compound is targeted to nucleotides 499-521 of SEQ ID NO: 9. In certain such embodiments, a short antisense compound targeted to nucleotides 499-521 comprises a nucleotide sequence selected from SEQ ID NO 488, 489, 490, 491, 492, 493, 494, 495, 496, or 497. In certain such embodiments, a short antisense compound targeted to nucleotides 499-521 of SEQ ID NO: 9 is selected from Isis No 327130, 327131, 327132, 327133, 327134, 327135, 327136, 327137, 327138, or 327139.

In certain embodiments, a target region is nucleotides 531-553 of SEQ ID NO: 9. In certain embodiments, a short antisense compound is targeted to nucleotides 531-553 of SEQ ID NO: 9. In certain such embodiments, a short antisense compound targeted to nucleotides 531-553 comprises a nucleotide sequence selected from SEQ ID NO 498, 499, 500, 501, 502, 503, 504, 505, 506, or 507. In certain such embodiments, a short antisense compound targeted to nucleotides 531-553 of SEQ ID NO: 9 is selected from Isis No 327140, 327141, 327142, 327143, 327144, 327145, 327146, 327147, 327148, or 327149.

In certain embodiments, a target region is nucleotides 545-567 of SEQ ID NO: 9. In certain embodiments, a short antisense compound is targeted to nucleotides 545-567 of SEQ ID NO: 9. In certain such embodiments, a short antisense compound targeted to nucleotides 545-567 comprises a nucleotide sequence selected from SEQ ID NO 508, 509, 510, 511, 512, 513, 514, 515, 516, or 517. In certain such embodiments, a short antisense compound targeted to nucleotides 545-567 of SEQ ID NO: 9 is selected from Isis No 327150, 327151, 327152, 327153, 327154, 327155, 327156, 327157, 327158, or 327159.

In certain embodiments, a target region is nucleotides 531-567 of SEQ ID NO: 9. In certain embodiments, a short antisense compound is targeted to nucleotides 531-567 of SEQ ID NO: 9. In certain such embodiments, a short antisense compound targeted to nucleotides 531-567 comprises a nucleotide sequence selected from SEQ ID NO 498, 499, 500, 501, 502, 503, 504, 505, 506, 507, 508, 509, 510, 511, 512, 513, 514, 515, 516, or 517. In certain such embodiments, a short antisense compound targeted to nucleotides 531-567 of SEQ ID NO: 9 is selected from Isis No 327140, 327141, 327142, 327143, 327144, 327145, 327146, 327147, 327148, 327149, 327150, 327151, 327152, 327153, 327154, 327155, 327156, 327157, 327158, or 327159.

In certain embodiments, a target region is nucleotides 684-714 of SEQ ID NO: 9. In certain embodiments, a short antisense compound is targeted to nucleotides 684-714 of SEQ ID NO: 9. In certain such embodiments, a short antisense compound targeted to nucleotides 684-714 comprises a nucleotide sequence selected from SEQ ID NO 518, 520, 521, 522, 523, 524, 525, 526, 527, 528, 529, 530, 531, 532, 533, 534, 535, or 536. In certain such embodiments, a short antisense compound targeted to nucleotides 684-714 of SEQ ID NO: 9 is selected from Isis No 345897, 327160, 327161, 327162, 327163, 327164, 327165, 327166, 327167, 327168, 327169, 327170, 327171, 327172, 327173, 327174, 327175, 327176, or 327177.

In certain embodiments, a target region is nucleotides 869-891 of SEQ ID NO: 9. In certain embodiments, a short antisense compound is targeted to nucleotides 869-891 of SEQ ID NO: 9. In certain such embodiments, a short antisense compound targeted to nucleotides 869-891 comprises a nucleotide sequence selected from SEQ ID NO 537, 538, 539, 540, 541, 542, 543, 544, 545, or 546. In certain such embodiments, a short antisense compound targeted to nucleotides 869-891 of SEQ ID NO: 9 is selected from Isis No 327178, 327179, 327180, 327181, 327182, 327183, 327184, 327185, 327186, or 327187.

In certain embodiments, a target region is nucleotides 955-977 of SEQ ID NO: 9. In certain embodiments, a short antisense compound is targeted to nucleotides 955-977 of SEQ ID NO: 9. In certain such embodiments, a short antisense compound targeted to nucleotides 955-977 comprises a nucleotide sequence selected from SEQ ID NO 547, 548, 549, 550, 551, 552, 553, 554, 555, or 556. In certain such embodiments, a short antisense compound targeted to nucleotides 955-977 of SEQ ID NO: 9 is selected from Isis No 327188, 327189, 327190, 327191, 327192, 327193, 327194, 327195, 327196, or 327197.

In certain embodiments, a target region is nucleotides 1019-1041 of SEQ ID NO: 9. In certain embodiments, a short antisense compound is targeted to nucleotides 1019-1041 of SEQ ID NO: 9. In certain such embodiments, a short antisense compound targeted to nucleotides 1019-1041 comprises a nucleotide sequence selected from SEQ ID NO 557, 558, 559, 560, 561, 562, 563, 564, 565, or 566. In certain such embodiments, a short antisense compound targeted to nucleotides 1019-1041 of SEQ ID NO: 9 is selected from Isis No 327198, 327199, 327200, 327201, 327202, 327203, 327204, 327205, 327206, or 327207.

In certain embodiments, a target region is nucleotides 1160-1175 of SEQ ID NO: 9. In certain embodiments, a short antisense compound is targeted to nucleotides 1160-1175 of SEQ ID NO: 9. In certain such embodiments, a short antisense compound targeted to nucleotides 1160-1175 comprises a nucleotide sequence selected from SEQ ID NO 567 or 568. In certain such embodiments, a short antisense compound targeted to nucleotides 1160-1175 of SEQ ID NO: 9 is selected from Isis No 338491 or 338562.

In certain embodiments, a target region is nucleotides 1307-1377 of SEQ ID NO: 9. In certain embodiments, a short antisense compound is targeted to nucleotides 1307-1377 of SEQ ID NO: 9. In certain such embodiments, a short antisense compound targeted to nucleotides 1307-1377 comprises a nucleotide sequence selected from SEQ ID NO 569, 570, 571, 572, or 573. In certain such embodiments, a short antisense compound targeted to nucleotides 1307-1377 of SEQ ID NO: 9 is selected from Isis No 338498, 338569, 338499, 338570, or 385067.

In certain embodiments, a target region is nucleotides 1307-1414 of SEQ ID NO: 9. In certain embodiments, a short antisense compound is targeted to nucleotides 1307-1414 of SEQ ID NO: 9. In certain such embodiments, a short antisense compound targeted to nucleotides 1307-1414 comprises a nucleotide sequence selected from SEQ ID NO 569, 570, 571, 572, 573, or 574. In certain such embodiments, a short antisense compound targeted to nucleotides 1307-1414 of SEQ ID NO: 9 is selected from Isis No 338498, 338569, 338499, 338570, 385067, or 338573.

In certain embodiments, short antisense compounds targeted to a GCGR nucleic acid are 8 to 16, preferably 9 to 15, more preferably 9 to 14, more preferably 10 to 14 nucleotides in length. In certain embodiments, short antisense compounds targeted to a GCGR nucleic acid are 9 to 14 nucleotides in length. In certain embodiments, short antisense compounds targeted to a GCGR nucleic acid are 10 to 14 nucleotides in length. In certain embodiments, such short antisense compounds are short antisense oligonucleotides.

In certain embodiments, short antisense compounds targeted to a GCGR nucleic acid are short gapmers. In certain such embodiments, short gapmers targeted to a GCGR nucleic acid comprise at least one high affinity modification in one or more wings of the compound. In certain embodiments, short antisense compounds targeted to a GCGR nucleic acid comprise 1 to 3 high-affinity modifications in each wing. In certain such embodiments, the nucleosides or nucleotides of the wing comprise a 2' modification. In certain such embodiments, the monomers of the wing are BNA's. In certain such embodiments, the monomers of the wing are selected from α-L-Methyleneoxy (4'-CH$_2$—O-2') BNA, β-D-Methyleneoxy (4'-CH$_2$—O-2') BNA, Ethyleneoxy (4'-(CH$_2$)$_2$—O-2') BNA, Aminooxy (4'-CH$_2$—O—N(R)-2') BNA and Oxyamino (4'-CH$_2$—N(R)—O-2') BNA. In certain embodiments, the monomers of a wing comprise a substituent at the 2' position selected from allyl, amino, azido, thio, O-allyl, O—C$_1$-C$_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), and O—CH$_2$—C(=O)—N(R$_m$)(R$_n$), where each R$_m$ and R$_n$ is, independently, H or substituted or unsubstituted C$_1$-C$_{10}$ alkyl. In certain embodiments, the monomers of a wing are 2'MOE nucleotides.

In certain embodiments, short antisense compounds targeted to a GCGR nucleic acid comprise a gap between the 5' wing and the 3' wing. In certain embodiments the gap comprises five, six, seven, eight, nine, ten, eleven, twelve, thirteen, or fourteen monomers. In certain embodiments, the monomers of the gap are unmodified deoxyribonucleotides. In certain embodiments, the monomers of the gap are unmodified ribonucleotides. In certain embodiments, gap modifications (if any) gap result in an antisense compound that, when bound to its target nucleic acid, supports cleavage by an RNase, including, but not limited to, RNase H.

In certain embodiments, short antisense compounds targeted to a GCGR nucleic acid have uniform monomeric linkages. In certain such embodiments, those linkages are all phosphorothioate linkages. In certain embodiments, the linkages are all phosphodiester linkages. In certain embodiments, short antisense compounds targeted to a GCGR nucleic acid have mixed backbones.

In certain embodiments, short antisense compounds targeted to a GCGR nucleic acid are 8 monomers in length. In certain embodiments, short antisense compounds targeted to a GCGR nucleic acid are 9 monomers in length. In certain embodiments, short antisense compounds targeted to a GCGR nucleic acid are 10 monomers in length. In certain embodiments, short antisense compounds targeted to a GCGR nucleic acid are 11 monomers in length. In certain embodiments, short antisense compounds targeted to a GCGR nucleic acid are monomers in length. In certain embodiments, short antisense compounds targeted to a GCGR nucleic acid are 13 monomers in length. In certain embodiments, short antisense compounds targeted to a GCGR nucleic acid are 14 monomers in length. In certain embodiments, short antisense compounds targeted to a GCGR nucleic acid are 15 monomers in length. In certain embodiments, short antisense compounds targeted to a GCGR nucleic acid are 16 monomers in length. In certain embodiments, short antisense compounds targeted to a GCGR nucleic acid comprise 9 to 15 monomers. In certain embodiments, short antisense compounds targeted to a GCGR nucleic acid comprise 10 to 15 monomers. In certain embodiments, short antisense compounds targeted to a GCGR nucleic acid comprise 12 to 14 monomers. In certain embodiments, short antisense compounds targeted to a GCGR nucleic acid comprise 12 to 14 nucleotides or nucleosides.

In certain embodiments, the invention provides methods of modulating expression of GCGR. In certain embodiments, such methods comprise use of one or more short antisense compound targeted to a GCGR nucleic acid, wherein the short antisense compound targeted to a GCGR nucleic acid is from about 8 to about 16, preferably 9 to 15, more preferably 9 to 14, more preferably 10 to 14 monomers (i.e. from about 8 to about 16 linked monomers). One of ordinary skill in the art will appreciate that this comprehends methods of modulating expression of GCGR using one or more short antisense compounds targeted to a GCGR nucleic acid of 8, 9, 10, 11, 12, 13, 14, 15 or 16 monomers.

In certain embodiments, methods of modulating GCGR comprise use of a short antisense compound targeted to a GCGR nucleic acid that is 8 monomers in length. In certain embodiments, methods of modulating GCGR comprise use of a short antisense compound targeted to a GCGR nucleic acid that is 9 monomers in length. In certain embodiments, methods of modulating GCGR comprise use of a short antisense compound targeted to a GCGR nucleic acid that is 10 monomers in length. In certain embodiments, methods of modulating GCGR comprise use of a short antisense compound targeted to a GCGR nucleic acid that is 11 monomers in length. In certain embodiments, methods of modulating GCGR comprise use of a short antisense compound targeted to a GCGR nucleic acid that is 12 monomers in length. In certain embodiments, methods of modulating GCGR comprise use of a short antisense compound targeted to a GCGR nucleic acid that is 13 monomers in length. In certain embodiments, methods of modulating GCGR comprise use of a short antisense compound targeted to a GCGR nucleic acid that is 14 monomers in length. In certain embodiments, methods of modulating GCGR comprise use of a short antisense compound targeted to a GCGR nucleic acid that is 15 monomers in length. In certain embodiments, methods of modulating GCGR comprise use of a short antisense compound targeted to a GCGR nucleic acid that is 16 monomers in length.

In certain embodiments, methods of modulating expression of GCGR comprise use of a short antisense compound targeted to a GCGR nucleic acid comprising 9 to 15 monomers. In certain embodiments, methods of modulating expression of GCGR comprise use of a short antisense compound targeted to a GCGR nucleic acid comprising 10 to 15 monomers. In certain embodiments, methods of modulating expression of GCGR comprise use of a short antisense compound targeted to a GCGR nucleic acid comprising 12 to 14 monomers. In certain embodiments, methods of modulating expression of GCGR comprise use of a short antisense compound targeted to a GCGR nucleic acid comprising 12 or 14 nucleotides or nucleosides.

8. DGAT2

Diacylglycerol transferase 2 (also known as DGAT2, diacylglycerol O-transferase 2, acyl-CoA:diacylglycerol acyltransferase 2), Diacylglycerol transferase 2 has been shown to be implicated in the absorption process of triglycerides (also called triacylglycerols) from food.

The absorption of triglycerides from food is a very efficient process which occurs by a series of steps wherein the dietary triacylglycerols are hydrolyzed in the intestinal lumen and then resynthesized within enterocytes. The resynthesis of triacylglycerols can occur via the monoacylglycerol pathway which commences with monoacylglycerol acyltransferase (MGAT) catalyzing the synthesis of diacylglycerol from monoacylglycerol and fatty acyl-CoA. An alternative synthesis of diacylglycerols is provided by the glycerol-phosphate pathway which describes the coupling of two molecules of fatty acyl-CoA to glycerol-3-phosphate. In either case, diacylglycerol is then acylated with another molecule of fatty acyl-CoA in a reaction catalyzed by one of two diacylglycerol acyltransferase enzymes to form the triglyceride (Farese et al., *Curr. Opin. Lipidol.*, 2000, 11, 229-234).

The reaction catalyzed by diacylglycerol acyltransferase is the final and only committed step in triglyceride synthesis. As such, diacylglycerol acyltransferase is involved in intestinal fat absorption, lipoprotein assembly, regulating plasma triglyceride concentrations, and fat storage in adipocytes. The first diacylglycerol acyltransferase, diacylglycerol transferase 1, was identified in 1960 and the human and mouse genes encoding this protein were isolated in 1998 (Cases et al., *Proc. Natl. Acad. Sci. U.S.A.*, 1998, 95, 13018-13023; Oelkers et al., *J. Biol. Chem.*, 1998, 273, 26765-26771). Mice lacking diacylglycerol acyltransferase 1 are viable and can still synthesize triglycerides through other biological routes, suggesting the existence of multiple mechanisms for triglyceride synthesis (Smith et al., *Nat. Genet.*, 2000, 25, 87-90).

A second diacylglycerol transferase, diacylglycerol transferase 2 (also known as DGAT2, diacylglycerol O-transferase 2, acyl-CoA:diacylglycerol acyltransferase 2), was subsequently identified in the fungus *Mortierella*, humans and mice (Cases et al., *J. Biol. Chem.*, 2001, 276, 38870-38876; Lardizabal et al., *J. Biol. Chem.*, 2001, 276, 38862-38869). Enzymatic assays indicate that this recently identified protein does possess diacylglycerol transferase activity that utilizes a broad range of long chain fatty acyl-CoA substrates (Cases et al., *J. Biol. Chem.*, 2001, 276, 38870-38876).

Diacylglycerol transferase 2 is a member of a family of genes whose sequences are unrelated to diacylglycerol transferase 1. In addition to differing in sequence compared to diacylglycerol transferase 1, in vitro assays illustrate that diacylglycerol transferase 2 has higher activity at lower concentrations of magnesium chloride and oleoyl-CoA (Cases et al., *J. Biol. Chem.*, 2001, 276, 38870-38876). The predicted protein sequence of diacylglycerol transferase 2 contains at least one putative transmembrane domain, three potential N-linked glycosylation sites, six potential protein kinase C phosphorylation consensus sites, as well as sequences in common with a putative glycerol phosphorylation site found in acyltransferase enzymes (Cases et al., *J. Biol. Chem.*, 2001, 276, 38870-38876). The International Radiation Hybrid Mapping Consortium has mapped human diacylglycerol transferase 2 to chromosome 11q13.3.

In human tissues, the highest levels of diacylglycerol transferase 2 are detected in liver and white adipose tissues, with lower levels found in mammary gland, testis and peripheral blood leukocytes (Cases et al., *J. Biol. Chem.*, 2001, 276, 38870-38876). Two mRNA species of 2.4 and 1.8 kilobases are detected in human tissues, whereas the major diacylglycerol transferase 2 mRNA species in mouse tissues is 2.4 kilobases. In addition to liver and white adipose tissues, diacylglycerol transferase 2 is expressed in all segments of the small intestine in mice, with higher expression in the proximal intestine and lower expression in the distal intestine (Cases et al., *J. Biol. Chem.*, 2001, 276, 38870-38876).

Diacylglycerol transferase activity exhibits distinct patterns during postnatal development of the rat liver. As there is no correlation between the mRNA expression and activity patterns, post-translational modifications may participate in the regulation of diacylglycerol transferase 2 activity during rat development (Waterman et al., *J. Lipid. Res.*, 2002, 43, 1555-1562).

Diacylglycerol transferase 2 mRNA is preferentially upregulated by insulin treatment, as shown by in vitro assays measuring the diacylglycerol activity from the membrane fraction of cultured mouse adipocytes (Meegalla et al., *Biochem. Biophys. Res. Commun.*, 2002, 298, 317-323). In fasting mice, diacylglycerol transferase 2 expression is greatly reduced, and dramatically increases upon refeeding. The expression patterns of two enzymes that participate in fatty acid synthesis, acetyl-CoA carboxylase and fatty acid synthase, respond to fasting and refeeding in a similar fashion. These results, combined with the observation that diacylglycerol transferase 2 is abundantly expressed in liver, suggest that diacylglycerol transferase 2 is tightly linked to the endogenous fatty acid synthesis pathway (Meegalla et al., *Biochem. Biophys. Res. Commun.*, 2002, 298, 317-323).

Studies of mice harboring a disruption in the diacylglycerol acyltransferase 1 gene provide evidence that diacylglycerol acyltransferase 2 contributes to triglyceride synthesis. Levels of diacylglycerol transferase 2 mRNA expression are similar in intestinal segments from both wild type and diacylglycerol transferase 1-deficient mice (Buhman et al., *J. Biol. Chem.*, 2002, 277, 25474-25479). Using magnesium chloride to distinguish between diacylglycerol transferase 1 and 2 activity, Buhman, et al. observed that, in diacylglycerol transferase 1-deficient mice, diacylglycerol transferase activity is reduced to 50% in the proximal intestine and to 10-15% in the distal intestine (Buhman et al., *J. Biol. Chem.*, 2002, 277, 25474-25479).

Additionally, diacylglycerol transferase 2 mRNA levels are not up-regulated the liver or adipose tissues of diacylglycerol transferase 1-deficient mice, even after weeks of high-fat diet (Cases et al., *J. Biol. Chem.*, 2001, 276, 38870-38876; Chen et al., *J. Clin. Invest.*, 2002, 109, 1049-1055). However, in ob/ob mice, which have a mutation in the leptin gene that results in obesity, diacylglycerol transferase 2 is more highly expressed than in wild type mice, suggesting that diacylglycerol transferase 2 may be partly responsible for the highly accumulated fat mass seen in these mice. Furthermore, the combined mutations of leptin and diacylglycerol transferase 1 leads to a three-fold elevation in diacylglycerol transferase 2 expression in white adipose tissue, compared to the levels in the same tissue from diacylglycerol transferase 1-deficient mice (Chen et al., *J. Clin. Invest.*, 2002, 109, 1049-1055). Diacylglycerol transferase 2 mRNA is also upregulated in the skin of these mice (Chen et al., *J. Clin. Invest.*, 2002, 109, 175-181). These data suggest leptin normally downregulates diacylglycerol transferase 2 expression, and that the upregulation of diacylglycerol transferase 2 in white adipose tissue in these mice may provide an alternate pathway for the triglyceride synthesis that still occurs in leptin deficient/diacylglycerol transferase 1-deficient mice (Chen et al., *J. Clin. Invest.*, 2002, 109, 1049-1055).

Diacylglycerol acyltransferase 1 knockout mice exhibit interesting phenotypes in that they are lean, resistant to diet-induce obesity, have decreased levels of tissue triglycerides and increased sensitivity to insulin and leptin (Chen et al., *J. Clin. Invest.*, 2002, 109, 1049-1055; Smith et al., *Nat. Genet.*, 2000, 25, 87-90). As diacylglycerol transferase 2 also participates in triglyceride synthesis, interfering with diacylglycerol transferase 2 may similarly lead to reduced body fat content.

Definitions

"DGAT2" means the gene product or protein of which expression is to be modulated by administration of a short antisense compound.

"DGAT2 nucleic acid" means any nucleic acid encoding DGAT2. For example, in certain embodiments, a DGAT2 nucleic acid includes, without limitation, a DNA sequence encoding DGAT2, an RNA sequence transcribed from DNA encoding DGAT2, and an mRNA sequence encoding DGAT2.

"DGAT2 mRNA" means an mRNA encoding DGAT2.

Therapeutic Indications

Antisense technology is an effective means for reducing DGAT2 expression and has proven to be uniquely useful in a number of therapeutic, diagnostic, and research applications. As such, in certain embodiments, the present invention provides compounds targeted to nucleic acid encoding DGAT2, which modulate the expression of DGAT2. Further provided herein are short antisense compounds capable of effectively inhibiting DGAT2 expression.

In certain embodiments, a subject, suspected of having a disease or associated with DGAT2 is treated by administering one or more short antisense compounds targeted to a nucleic acid encoding DGAT2. For example, in a non-limiting embodiment, such methods comprise the step of administering to an animal a therapeutically effective amount of a short antisense compound. In certain such embodiments, short antisense compounds effectively inhibit the activity of DGAT2 or inhibit the expression of DGAT2. In one embodiment, the activity or expression of DGAT2 in a subject is inhibited by at least 10%, by at least 20%, by at least 25%, by at least 30%, by at least 40%, by at least 50%, by at least 60%, by at least 70%, by at least 75%, by at least 80%, by at least 85%, by at least 90%, by at least 95%, by at least 98%, by at least 99%, or by 100%. In certain embodiments, the activity or expression of DGAT2 in a subject is inhibited by about 30%. More preferably, the activity or expression of DGAT2 in a subject is inhibited by 50% or more.

The reduction of the expression of DGAT2 may be measured, for example, in blood, plasma, serum, adipose tissue, liver or any other body fluid, tissue or organ of the animal. Preferably, the cells contained within said fluids, tissues or organs being analyzed contain a nucleic acid molecule encoding DGAT2 and/or the DGAT2 protein itself.

In certain embodiments, pharmaceutical and other compositions comprising the compounds of the invention are also provided. For example, short antisense compounds targeted to a DGAT2 nucleic acid can be utilized in pharmaceutical compositions by adding an effective amount of a compound to a suitable pharmaceutically acceptable diluent or carrier.

Certain short antisense compounds targeting DGAT2 may have any one or more properties or characteristics of the short antisense compounds generally described herein. In certain embodiments, short antisense compounds targeting a DGAT2 nucleic acid have a motif (wing-deoxy gap-wing) selected from 1-12-1, 1-1-10-2, 2-10-1-1, 3-10-3, 2-10-3, 2-10-2, 1-10-1, 1-10-2, 3-8-3, 2-8-2, 1-8-1, 3-6-3 or 1-6-1. In certain embodiments, short antisense compounds targeting a DGAT2 nucleic acid have a motif (wing-deoxy gap-wing) selected from 1-10-1, 2-10-2 and 3-10-3.

Provided herein are methods of treating an individual by administering one or more short antisense compound targeted to a DGAT2 nucleic acid or a pharmaceutical composition comprising such compound. Further provided are methods of treating a subject having a disease or conditions associated with DGAT2 activity by administering a short antisense compound targeted to a DGAT2 nucleic acid. Diseases and conditions associated with DGAT2 include, but are not limited to, cardiovascular disorders, obesity, diabetes, cholesterolemia, and liver steatosis.

Certain Short Antisense Compounds Targeted to a DGAT2 Nucleic Acid

In certain embodiments, short antisense compounds are targeted to a DGAT2 nucleic acid having the sequence of GENBANK® Accession No. NM_032564.2, incorporated herein as SEQ ID NO: 10. In certain such embodiments, a short antisense compound targeted to SEQ ID NO: 10 is at least 90% complementary to SEQ ID NO: 10. In certain such embodiments, a short antisense compound targeted to SEQ ID NO: 10 is at least 95% complementary to SEQ ID NO: 10. In certain such embodiments, a short antisense compound targeted to SEQ ID NO: 10 is 100% complementary to SEQ ID NO: 10. In certain embodiments, a short antisense compound targeted to SEQ ID NO: 10 includes a nucleotide sequence selected from the nucleotide sequences set forth in Tables 14 and 15.

Each nucleotide sequence set forth in each Tables 14 and 15 is independent of any modification to a sugar moiety, an internucleoside linkage, or a nucleobase. As such, short antisense compounds comprising a nucleotide sequence as set forth in Tables 14 and 15 may comprise, independently, one or more modifications to a sugar moiety, an internucleoside linkage, or a nucleobase. Antisense compounds described by Isis Number (Isis NO.) indicate a combination of nucleobase sequence and one or more modifications to a sugar moiety, an internucleoside linkage, or a nucleobase.

Tables 14 and 15 illustrate examples of short antisense compounds targeted to SEQ ID NO: 10. Table 14 illustrates short antisense compounds that are 100% complementary to SEQ ID NO: 10. Table 15 illustrates short antisense compounds that have one or two mismatches with respect to SEQ ID NO: 10. The column labeled 'gapmer motif' indicates the wing-gap-wing motif of each short antisense compounds. The gap segment comprises 2'-deoxynucleotides and each nucleotide of each wing segment comprises a 2'-modified sugar. The particular 2'-modified sugar is also indicated in the 'gapmer motif' column. For example, '2-10-2 MOE' means a 2-10-2 gapmer motif, where a gap segment of ten 2'-deoxynucleotides is flanked by wing segments of two nucleotides, where the nucleotides of the wing segments are 2'-MOE nucleotides. Internucleoside linkages are phosphorothioate. The short antisense compounds comprise 5-methylcytidine in place of unmodified cytosine, unless "unmodified cytosine" is listed in the gapmer motif column, in which case the indicated cytosines are unmodified cytosines. For example, "5-mC in gap only" indicates that the gap segment has 5-methylcytosines, while the wing segments have unmodified cytosines.

TABLE 14

Short Antisense Compounds targeted to SEQ ID NO: 10

| ISIS NO. | 5' Target Site | 3' Target Site | Sequence (5'-3') | Gapmer Motif | SEQ ID NO |
|---|---|---|---|---|---|
| 372556 | 231 | 244 | ATGAGGGTCTTCAT | 2-10-2 MOE | 681 |
| 372557 | 249 | 262 | ACCCCGGAGTAGGC | 2-10-2 MOE | 682 |
| 382601 | 249 | 260 | CCCGGAGTAGGC | 1-10-1 MOE | 683 |
| 372480 | 251 | 266 | CAGGACCCCGGAGTAG | 3-10-3 MOE | 684 |

TABLE 14-continued

Short Antisense Compounds targeted to SEQ ID NO: 10

| ISIS NO. | 5' Target Site | 3' Target Site | Sequence (5'-3') | Gapmer Motif | SEQ ID NO |
|---|---|---|---|---|---|
| 372481 | 252 | 267 | GCAGGACCCCGGAGTA | 3-10-3 MOE | 685 |
| 372558 | 252 | 265 | AGGACCCCGGAGTA | 2-10-2 MOE | 686 |
| 372559 | 253 | 266 | CAGGACCCCGGAGT | 2-10-2 MOE | 687 |
| 382603 | 331 | 342 | CAGACCCCTCGC | 1-10-1 MOE | 688 |
| 382604 | 361 | 372 | AGAGGATGCTGG | 1-10-1 MOE | 689 |
| 372485 | 392 | 407 | GAGCCAGGTGACAGAG | 3-10-3 MOE | 690 |
| 372563 | 393 | 406 | AGCCAGGTGACAGA | 2-10-2 MOE | 691 |
| 382605 | 397 | 408 | TGAGCCAGGTGA | 1-10-1 MOE | 692 |
| 372565 | 414 | 427 | TTTTCCACCTTGGA | 2-10-2 MOE | 693 |
| 382606 | 482 | 493 | CTGCAGGCCACT | 1-10-1 MOE | 694 |
| 372497 | 651 | 666 | TCACCAGCTGGATGGG | 3-10-3 MOE | 695 |
| 372498 | 652 | 667 | TTCACCAGCTGGATGG | 3-10-3 MOE | 696 |
| 372575 | 652 | 665 | CACCAGCTGGATGG | 2-10-2 MOE | 697 |
| 372576 | 653 | 666 | TCACCAGCTGGATG | 2-10-2 MOE | 698 |
| 382607 | 655 | 666 | TCACCAGCTGGA | 1-10-1 MOE | 699 |
| 372499 | 656 | 671 | TGTCTTCACCAGCTGG | 3-10-3 MOE | 700 |
| 372577 | 657 | 670 | GTCTTCACCAGCTG | 2-10-2 MOE | 701 |
| 372500 | 659 | 674 | GTGTGTCTTCACCAGC | 3-10-3 MOE | 702 |
| 372578 | 660 | 673 | TGTGTCTTCACCAG | 2-10-2 MOE | 703 |
| 372501 | 661 | 676 | TTGTGTGTCTTCACCA | 3-10-3 MOE | 704 |
| 372579 | 662 | 675 | TGTGTGTCTTCACC | 2-10-2 MOE | 705 |
| 372502 | 664 | 679 | AGGTTGTGTGTCTTCA | 3-10-3 MOE | 706 |
| 372580 | 665 | 678 | GGTTGTGTGTCTTC | 2-10-2 MOE | 707 |
| 372503 | 666 | 681 | GCAGGTTGTGTGTCTT | 3-10-3 MOE | 708 |
| 372581 | 667 | 680 | CAGGTTGTGTGTCT | 2-10-2 MOE | 709 |
| 372504 | 669 | 684 | TCAGCAGGTTGTGTGT | 3-10-3 MOE | 710 |
| 372582 | 670 | 683 | CAGCAGGTTGTGTG | 2-10-2 MOE | 711 |
| 372505 | 671 | 686 | GGTCAGCAGGTTGTGT | 3-10-3 MOE | 712 |
| 372506 | 672 | 687 | TGGTCAGCAGGTTGTG | 3-10-3 MOE | 713 |
| 372583 | 672 | 685 | GTCAGCAGGTTGTG | 2-10-2 MOE | 714 |
| 372584 | 673 | 686 | GGTCAGCAGGTTGT | 2-10-2 MOE | 715 |
| 372507 | 676 | 691 | CTGGTGGTCAGCAGGT | 3-10-3 MOE | 716 |
| 372585 | 677 | 690 | TGGTGGTCAGCAGG | 2-10-2 MOE | 717 |
| 382608 | 680 | 691 | CTGGTGGTCAGC | 1-10-1 MOE | 718 |
| 372508 | 681 | 696 | AGTTCCTGGTGGTCAG | 3-10-3 MOE | 719 |
| 372586 | 682 | 695 | GTTCCTGGTGGTCA | 2-10-2 MOE | 720 |

TABLE 14-continued

Short Antisense Compounds targeted to SEQ ID NO: 10

| ISIS NO. | 5' Target Site | 3' Target Site | Sequence (5'-3') | Gapmer Motif | SEQ ID NO |
|---|---|---|---|---|---|
| 372509 | 684 | 699 | TATAGTTCCTGGTGGT | 3-10-3 MOE | 721 |
| 372587 | 685 | 698 | ATAGTTCCTGGTGG | 2-10-2 MOE | 722 |
| 372510 | 686 | 701 | GATATAGTTCCTGGTG | 3-10-3 MOE | 723 |
| 372588 | 687 | 700 | ATATAGTTCCTGGT | 2-10-2 MOE | 724 |
| 372511 | 691 | 706 | CCAAAGATATAGTTCC | 3-10-3 MOE | 725 |
| 372512 | 692 | 707 | TCCAAAGATATAGTTC | 3-10-3 MOE | 726 |
| 372589 | 692 | 705 | CAAAGATATAGTTC | 2-10-2 MOE | 727 |
| 372590 | 693 | 706 | CCAAAGATATAGTT | 2-10-2 MOE | 728 |
| 382609 | 724 | 735 | CCAGGCCCATGA | 1-10-1 MOE | 729 |
| 372514 | 725 | 740 | GGCACCCAGGCCCATG | 3-10-3 MOE | 730 |
| 372592 | 726 | 739 | GCACCCAGGCCCAT | 2-10-2 MOE | 731 |
| 372515 | 730 | 745 | CAGAAGGCACCCAGGC | 3-10-3 MOE | 732 |
| 372593 | 731 | 744 | AGAAGGCACCCAGG | 2-10-2 MOE | 733 |
| 382610 | 851 | 862 | CCAGACATCAGG | 1-10-1 MOE | 734 |
| 382611 | 867 | 878 | GACAGGGCAGAT | 1-10-1 MOE | 735 |
| 382602 | 868 | 879 | TGACAGGGCAGA | 1-10-1 MOE | 736 |
| 382612 | 911 | 922 | CCACTCCCATTC | 1-10-1 MOE | 737 |
| 372524 | 965 | 980 | GCCAGGCATGGAGCTC | 3-10-3 MOE | 738 |
| 372602 | 966 | 979 | CCAGGCATGGAGCT | 2-10-2 MOE | 739 |
| 382613 | 968 | 979 | CCAGGCATGGAG | 1-10-1 MOE | 740 |
| 382614 | 987 | 998 | CAGGGTGACTGC | 1-10-1 MOE | 741 |
| 372525 | 989 | 1004 | GTTCCGCAGGGTGACT | 3-10-3 MOE | 742 |
| 372603 | 990 | 1003 | TTCCGCAGGGTGAC | 2-10-2 MOE | 743 |
| 372526 | 992 | 1007 | GCGGTTCCGCAGGGTG | 3-10-3 MOE | 744 |
| 372604 | 993 | 1006 | CGGTTCCGCAGGGT | 2-10-2 MOE | 745 |
| 372530 | 1106 | 1121 | TCGGCCCCAGGAGCCC | 3-10-3 MOE | 746 |
| 372608 | 1107 | 1120 | CGGCCCCAGGAGCC | 2-10-2 MOE | 747 |
| 372531 | 1109 | 1124 | CCATCGGCCCCAGGAG | 3-10-3 MOE | 748 |
| 372609 | 1110 | 1123 | CATCGGCCCCAGGA | 2-10-2 MOE | 749 |
| 372532 | 1112 | 1127 | GACCCATCGGCCCCAG | 3-10-3 MOE | 750 |
| 372610 | 1113 | 1126 | ACCCATCGGCCCCA | 2-10-2 MOE | 751 |
| 372533 | 1117 | 1132 | TTCTGGACCCATCGGC | 3-10-3 MOE | 752 |
| 382615 | 1117 | 1128 | GGACCCATCGGC | 1-10-1 MOE | 753 |
| 372611 | 1118 | 1131 | TCTGGACCCATCGG | 2-10-2 MOE | 754 |
| 372536 | 1199 | 1214 | CACCAGCCCCCAGGTG | 3-10-3 MOE | 755 |
| 372614 | 1200 | 1213 | ACCAGCCCCCAGGT | 2-10-2 MOE | 756 |
| 372537 | 1204 | 1219 | TAGGGCACCAGCCCCC | 3-10-3 MOE | 757 |
| 372615 | 1205 | 1218 | AGGGCACCAGCCCC | 2-10-2 MOE | 758 |
| 372538 | 1209 | 1224 | TGGAGTAGGGCACCAG | 3-10-3 MOE | 759 |
| 372616 | 1210 | 1223 | GGAGTAGGGCACCA | 2-10-2 MOE | 760 |
| 382616 | 1215 | 1226 | CTTGGAGTAGGG | 1-10-1 MOE | 761 |
| 372539 | 1218 | 1233 | TGATGGGCTTGGAGTA | 3-10-3 MOE | 762 |
| 372617 | 1219 | 1232 | GATGGGCTTGGAGT | 2-10-2 MOE | 763 |
| 372540 | 1293 | 1308 | TGTGGTACAGGTCGAT | 3-10-3 MOE | 764 |
| 372618 | 1294 | 1307 | GTGGTACAGGTCGA | 2-10-2 MOE | 765 |
| 382617 | 1294 | 1305 | GGTACAGGTCGA | 1-10-1 MOE | 766 |
| 372541 | 1295 | 1310 | GGTGTGGTACAGGTCG | 3-10-3 MOE | 767 |
| 372619 | 1296 | 1309 | GTGTGGTACAGGTC | 2-10-2 MOE | 768 |
| 372542 | 1298 | 1313 | CATGGTGTGGTACAGG | 3-10-3 MOE | 769 |
| 372620 | 1299 | 1312 | ATGGTGTGGTACAG | 2-10-2 MOE | 770 |
| 372543 | 1300 | 1315 | TACATGGTGTGGTACA | 3-10-3 MOE | 771 |
| 372621 | 1301 | 1314 | ACATGGTGTGGTAC | 2-10-2 MOE | 772 |
| 372544 | 1303 | 1318 | ATGTACATGGTGTGGT | 3-10-3 MOE | 773 |
| 372622 | 1304 | 1317 | TGTACATGGTGTGG | 2-10-2 MOE | 774 |
| 382618 | 1313 | 1324 | GCCTCCATGTAC | 1-10-1 MOE | 775 |
| 382619 | 1325 | 1336 | AGCTTCACCAGG | 1-10-1 MOE | 776 |
| 382620 | 1383 | 1394 | GTTCACCTCCAG | 1-10-1 MOE | 777 |

TABLE 15

Short antisense compounds targeted to SEQ ID NO: 10 and having 1 or 2 mismatches

| ISIS NO | 5' Target Site | 3' Target Site | Sequence (5'-3') | Gapmer Motif | SEQ ID NO |
|---|---|---|---|---|---|
| 372608 | 151 | 164 | CGGCCCCAGGAGCC | 2-10-2 MOE | 747 |
| 372474 | 156 | 171 | CATGCCCCAGCCGCCG | 3-10-3 MOE | 778 |
| 372552 | 157 | 170 | ATGCCCCAGCCGCC | 2-10-2 MOE | 779 |
| 382609 | 167 | 178 | CCAGGCCCATGA | 1-10-1 MOE | 729 |
| 372478 | 230 | 245 | GATGAGGGTCTTCATG | 3-10-3 MOE | 780 |
| 372479 | 248 | 263 | GACCCCGGAGTAGGCA | 3-10-3 MOE | 781 |
| 382611 | 317 | 328 | GACAGGGCAGAT | 1-10-1 MOE | 735 |
| 372483 | 352 | 367 | ATGCTGGAGCCAGTGC | 3-10-3 MOE | 782 |
| 372561 | 353 | 366 | TGCTGGAGCCAGTG | 2-10-2 MOE | 783 |

TABLE 15-continued

Short antisense compounds targeted to SEQ ID NO: 10 and having 1 or 2 mismatches

| ISIS NO | 5' Target Site | 3' Target Site | Sequence (5'-3') | Gapmer Motif | SEQ ID NO |
|---|---|---|---|---|---|
| 372562 | 373 | 386 | GTCTTGGAGGGCCG | 2-10-2 MOE | 784 |
| 382602 | 388 | 399 | TGACAGGGCAGA | 1-10-1 MOE | 736 |
| 372613 | 392 | 405 | CCCAGGTGTCAGAG | 2-10-2 MOE | 785 |
| 372486 | 412 | 427 | TTTTCCACCTTGGATC | 3-10-3 MOE | 786 |
| 372564 | 413 | 426 | TTTCCACCTTGGAT | 2-10-2 MOE | 787 |
| 372487 | 413 | 428 | TTTTTCCACCTTGGAT | 3-10-3 MOE | 788 |
| 372488 | 418 | 433 | AGGTGTTTTTCCACCT | 3-10-3 MOE | 789 |
| 372566 | 419 | 432 | GGTGTTTTTCCACC | 2-10-2 MOE | 790 |
| 372489 | 459 | 474 | CCAGGAAGGATAGGAC | 3-10-3 MOE | 791 |
| 372567 | 460 | 473 | CAGGAAGGATAGGA | 2-10-2 MOE | 792 |
| 382612 | 475 | 486 | CCACTCCCATTC | 1-10-1 MOE | 737 |
| 372490 | 483 | 498 | TGACACTGCAGGCCAC | 3-10-3 MOE | 793 |
| 372568 | 484 | 497 | GACACTGCAGGCCA | 2-10-2 MOE | 794 |
| 372491 | 492 | 507 | ACATGAGGATGACACT | 3-10-3 MOE | 795 |
| 372569 | 493 | 506 | CATGAGGATGACAC | 2-10-2 MOE | 796 |
| 372492 | 503 | 518 | GCAGAAGGTGTACATG | 3-10-3 MOE | 797 |
| 372570 | 504 | 517 | CAGAAGGTGTACAT | 2-10-2 MOE | 798 |
| 372493 | 512 | 527 | GCAGTCAGTGCAGAAG | 3-10-3 MOE | 799 |
| 372571 | 513 | 526 | CAGTCAGTGCAGAA | 2-10-2 MOE | 800 |
| 372496 | 612 | 627 | ACACGGCCCAGTTTCG | 3-10-3 MOE | 801 |
| 372574 | 613 | 626 | CACGGCCCAGTTTC | 2-10-2 MOE | 802 |
| 372513 | 717 | 732 | GGCCCATGATGCCATG | 3-10-3 MOE | 803 |
| 372591 | 718 | 731 | GCCCATGATGCCAT | 2-10-2 MOE | 804 |
| 372516 | 732 | 747 | TACAGAAGGCACCCAG | 3-10-3 MOE | 805 |
| 372594 | 733 | 746 | ACAGAAGGCACCCA | 2-10-2 MOE | 806 |
| 372518 | 812 | 827 | GAAGTTGCCAGCCAAT | 3-10-3 MOE | 807 |
| 372596 | 813 | 826 | AAGTTGCCAGCCAA | 2-10-2 MOE | 808 |
| 372560 | 863 | 876 | CAGGGCAGATCCTT | 2-10-2 MOE | 809 |
| 372519 | 887 | 902 | CAAGTAGTCTATGGTG | 3-10-3 MOE | 810 |
| 372597 | 888 | 901 | AAGTAGTCTATGGT | 2-10-2 MOE | 811 |
| 372520 | 894 | 909 | TGGAAAGCAAGTAGTC | 3-10-3 MOE | 812 |
| 372598 | 895 | 908 | GGAAAGCAAGTAGT | 2-10-2 MOE | 813 |
| 372527 | 1013 | 1028 | GGCCAGCTTTACAAAG | 3-10-3 MOE | 814 |
| 372605 | 1014 | 1027 | GCCAGCTTTACAAA | 2-10-2 MOE | 815 |
| 372606 | 1020 | 1033 | CGCAGGGCCAGCTT | 2-10-2 MOE | 816 |
| 372529 | 1052 | 1067 | AAAGGAATAGGTGGGA | 3-10-3 MOE | 817 |
| 372607 | 1053 | 1066 | AAGGAATAGGTGGG | 2-10-2 MOE | 818 |
| 372534 | 1144 | 1159 | GCGAAACCAATATACT | 3-10-3 MOE | 819 |
| 372612 | 1145 | 1158 | CGAAACCAATATAC | 2-10-2 MOE | 820 |
| 372535 | 1192 | 1207 | CCCCAGGTGTCAGAGG | 3-10-3 MOE | 821 |
| 372613 | 1193 | 1206 | CCCAGGTGTCAGAG | 2-10-2 MOE | 822 |
| 372545 | 1332 | 1347 | GATTGTCAAAGAGCTT | 3-10-3 MOE | 823 |
| 372623 | 1333 | 1346 | ATTGTCAAAGAGCT | 2-10-2 MOE | 824 |
| 372546 | 1342 | 1357 | TTGGTCTTGTGATTGT | 3-10-3 MOE | 825 |
| 372624 | 1343 | 1356 | TGGTCTTGTGATTG | 2-10-2 MOE | 826 |
| 372547 | 1352 | 1367 | AAGGCCGAATTTGGTC | 3-10-3 MOE | 827 |
| 372625 | 1353 | 1366 | AGGCCGAATTTGGT | 2-10-2 MOE | 828 |
| 382601 | 1617 | 1628 | CCCGGAGTAGGC | 1-10-1 MOE | 683 |
| 382606 | 1971 | 1982 | CTGCAGGCCACT | 1-10-1 MOE | 694 |
| 382612 | 1988 | 1999 | CCACTCCCATTC | 1-10-1 MOE | 737 |

In certain embodiments, a target region is nucleotides 231-267 of SEQ ID NO: 10. In certain embodiments, a short antisense compound is targeted to nucleotides 231-267 of SEQ ID NO: 10. In certain such embodiments, a short antisense compound targeted to nucleotides 231-267 comprises a nucleotide sequence selected from SEQ ID NO 681, 682, 683, 684, 685, 686, or 687. In certain such embodiments, a short antisense compound targeted to nucleotides 231-267 of SEQ ID NO: 10 is selected from Isis No 372556, 372557, 382601, 372480, 372481, 372558, or 372559.

In certain embodiments, a target region is nucleotides 249-267 of SEQ ID) NO: 10. In certain embodiments, a short antisense compound is targeted to nucleotides 249-267 of SEQ ID NO: 10. In certain such embodiments, a short antisense compound targeted to nucleotides 249-267 comprises a nucleotide sequence selected from SEQ ID NO 683, 684, 685, 686, or 687. In certain such embodiments, a short antisense compound targeted to nucleotides 249-267 of SEQ ID NO: 10 is selected from Isis No 382601, 372480, 372481, 372558, or 372559.

In certain embodiments, a target region is nucleotides 331-493 of SEQ ID NO: 10. In certain embodiments, a short antisense compound is targeted to nucleotides 331-493 of SEQ ID NO: 10. In certain such embodiments, a short antisense compound targeted to nucleotides 331-493 comprises a nucleotide sequence selected from SEQ ID NO 688, 689, 690, 691, 692, 693, or 694. In certain such embodiments, a short antisense compound targeted to nucleotides 331-493 of SEQ ID NO: 10 is selected from Isis No 382603, 382604, 372485, 372563, 382605, 372565, or 382606.

In certain embodiments, a target region is nucleotides 331-427 of SEQ ID NO: 10. In certain embodiments, a short antisense compound is targeted to nucleotides 331-427 of SEQ ID NO: 10. In certain such embodiments, a short antisense compound targeted to nucleotides 331-427 comprises a nucleotide sequence selected from SEQ ID NO 688, 689, 690, 691, 692, or 693. In certain such embodiments, a short antisense compound targeted to nucleotides 331-427 of SEQ ID NO: 10 is selected from Isis No 382603, 382604, 372485, 372563, 382605, or 372565.

In certain embodiments, a target region is nucleotides 392-408 of SEQ ID NO: 10. In certain embodiments, a short antisense compound is targeted to nucleotides 392-408 of SEQ ID NO: 10. In certain such embodiments, a short antisense compound targeted to nucleotides 392-408 comprises a nucleotide sequence selected from SEQ ID NO 690, 691, or 692. In certain such embodiments, a short antisense compound targeted to nucleotides 392-408 of SEQ ID NO: 10 is selected from Isis No 372485, 372563, or 382605.

In certain embodiments, a target region is nucleotides 651-707 of SEQ ID NO: 10. In certain embodiments, a short antisense compound is targeted to nucleotides 651-707 of SEQ ID NO: 10. In certain such embodiments, a short antisense compound targeted to nucleotides 651-707 comprises a nucleotide sequence selected from SEQ ID NO 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, or 728. In certain such embodiments, a short antisense compound targeted to nucleotides 651-707 of SEQ ID NO: 10 is selected from Isis No 372497, 372498, 372575, 372576, 382607, 372499, 372577, 372500, 372578, 372501, 372579, 372502, 372580, 372503, 372581, 372504, 372582, 372505, 372506, 372583, 372584, 372507, 372585, 382608, 372508, 372586, 372509, 372587, 372510, 372588, 372511, 372512, 372589, or 372590.

In certain embodiments, a target region is nucleotides 724-745 of SEQ ID NO: 10. In certain embodiments, a short antisense compound is targeted to nucleotides 724-745 of SEQ ID NO: 10. In certain such embodiments, a short antisense compound targeted to nucleotides 724-745 comprises a nucleotide sequence selected from SEQ ID NO 729, 730, 731, 732, or 733. In certain such embodiments, a short antisense compound targeted to nucleotides 724-745 of SEQ ID NO: 10 is selected from Isis No 382609, 372514, 372592, 372515, or 372593.

In certain embodiments, a target region is nucleotides 651-745 of SEQ ID NO: 10. In certain embodiments, a short antisense compound is targeted to nucleotides 651-745 of SEQ ID NO: 10. In certain such embodiments, a short antisense compound targeted to nucleotides 651-745 comprises a nucleotide sequence selected from SEQ ID NO 695, 696, 697, 698, 699, 700, 701, 702, 703, 704, 705, 706, 707, 708, 709, 710, 711, 712, 713, 714, 715, 716, 717, 718, 719, 720, 721, 722, 723, 724, 725, 726, 727, 728, 729, 730, 731, 732, or 733. In certain such embodiments, a short antisense compound targeted to nucleotides 651-745 of SEQ ID NO: 10 is selected from Isis No 372497, 372498, 372575, 372576, 382607, 372499, 372577, 372500, 372578, 372501, 372579, 372502, 372580, 372503, 372581, 372504, 372582, 372505, 372506, 372583, 372584, 372507, 372585, 382608, 372508, 372586, 372509, 372587, 372510, 372588, 372511, 372512, 372589, 372590, 382609, 372514, 372592, 372515, or 372593.

In certain embodiments, a target region is nucleotides 851-922 of SEQ ID NO: 10. In certain embodiments, a short antisense compound is targeted to nucleotides 851-922 of SEQ ID NO: 10. In certain such embodiments, a short antisense compound targeted to nucleotides 851-922 comprises a nucleotide sequence selected from SEQ ID NO 734, 735, 736, or 737. In certain such embodiments, a short antisense compound targeted to nucleotides 851-922 of SEQ ID NO: 10 is selected from Isis No 382610, 382611, 382602, or 382612.

In certain embodiments, a target region is nucleotides 851-879 of SEQ ID NO: 10. In certain embodiments, a short antisense compound is targeted to nucleotides 851-879 of SEQ ID NO: 10. In certain such embodiments, a short antisense compound targeted to nucleotides 851-879 comprises a nucleotide sequence selected from SEQ ID NO 734, 735, or 736. In certain such embodiments, a short antisense compound targeted to nucleotides 851-879 of SEQ ID NO: 10 is selected from Isis No 382610, 382611, or 382602.

In certain embodiments, a target region is nucleotides 965-1007 of SEQ ID NO: 10. In certain embodiments, a short antisense compound is targeted to nucleotides 965-1007 of SEQ ID NO: 10. In certain such embodiments, a short antisense compound targeted to nucleotides 965-1007 comprises a nucleotide sequence selected from SEQ ID NO 738, 739, 740, 741, 742, 743, 744, or 745. In certain such embodiments, a short antisense compound targeted to nucleotides 965-1007 of SEQ ID NO: 10 is selected from Isis No 372524, 372602, 382613, 382614, 372525, 372603, 372526, or 372604.

In certain embodiments, a target region is nucleotides 965-979 of SEQ ID NO: 10. In certain embodiments, a short antisense compound is targeted to nucleotides 965-979 of SEQ ID NO: 10. In certain such embodiments, a short antisense compound targeted to nucleotides 965-979 comprises a nucleotide sequence selected from SEQ ID NO 738, 739, or 740. In certain such embodiments, a short antisense compound targeted to nucleotides 965-979 of SEQ ID NO: 10 is selected from Isis No 372524, 372602, or 382613.

In certain embodiments, a target region is nucleotides 987-1007 of SEQ ID NO: 10. In certain embodiments, a short antisense compound is targeted to nucleotides 987-1007 of SEQ ID NO: 10. In certain such embodiments, a short antisense compound targeted to nucleotides 987-1007 comprises a nucleotide sequence selected from SEQ ID NO 741, 742, 743, 744, or 745. In certain such embodiments, a short antisense compound targeted to nucleotides 987-1007 of SEQ ID NO: 10 is selected from Isis No 382614, 372525, 372603, 372526, or 372604.

In certain embodiments, a target region is nucleotides 1106-1132 of SEQ ID NO: 10. In certain embodiments, a short antisense compound is targeted to nucleotides 1106-1132 of SEQ ID NO: 10. In certain such embodiments, a short antisense compound targeted to nucleotides 1106-1132 comprises a nucleotide sequence selected from SEQ ID NO 746, 747, 748, 749, 750, 751, 752, 753, or 754. In certain such embodiments, a short antisense compound targeted to nucleotides 1106-1132 of SEQ ID NO: 10 is selected from Isis No 372530, 372608, 372531, 372609, 372532, 372610, 372533, 382615, or 372611.

In certain embodiments, a target region is nucleotides 1199-1233 of SEQ ID NO: 10. In certain embodiments, a short antisense compound is targeted to nucleotides 1199-1233 of SEQ ID NO: 10. In certain such embodiments, a short antisense compound targeted to nucleotides 1199-1233 comprises a nucleotide sequence selected from SEQ ID NO 755, 756, 757, 758, 759, 760, 761, 762, or 763. In certain such embodiments, a short antisense compound targeted to nucleotides 1199-1233 of SEQ ID NO: 10 is selected from Isis No 372536, 372614, 372537, 372615, 372538, 372616, 382616, 372539, or 372617.

In certain embodiments, a target region is nucleotides 1293-1394 of SEQ ID NO: 10. In certain embodiments, a short antisense compound is targeted to nucleotides 1293-1394 of SEQ ID NO: 10. In certain such embodiments, a short antisense compound targeted to nucleotides 1293-1394 comprises a nucleotide sequence selected from SEQ ID NO 764, 765, 766, 767, 768, 769, 770, 771, 772, 773, 774, 775, 776, or 777. In certain such embodiments, a short antisense compound targeted to nucleotides 1293-1394 of SEQ ID NO: 10 is selected from Isis No 372540, 372618, 382617, 372541, 372619, 372542, 372620, 372543, 372621, 372544, 372622, 382618, 382619, or 382620.

In certain embodiments, a target region is nucleotides 1293-1336 of SEQ ID NO: 10. In certain embodiments, a short antisense compound is targeted to nucleotides 1293-1336 of SEQ ID NO: 10. In certain such embodiments, a short antisense compound targeted to nucleotides 1293-1336 comprises a nucleotide sequence selected from SEQ ID NO 764, 765, 766, 767, 768, 769, 770, 771, 772, 773, 774, 775, or 776. In certain such embodiments, a short antisense compound targeted to nucleotides 1293-1336 of SEQ ID NO: 10 is selected from Isis No 372540, 372618, 382617, 372541, 372619, 372542, 372620, 372543, 372621, 372544, 372622, 382618, or 382619.

In certain embodiments, a target region is nucleotides 1293-1324 of SEQ ID NO: 10. In certain embodiments, a short antisense compound is targeted to nucleotides 1293-1324 of SEQ ID NO: 10. In certain such embodiments, a short antisense compound targeted to nucleotides 1293-1324 comprises a nucleotide sequence selected from SEQ ID NO 764, 765, 766, 767, 768, 769, 770, 771, 772, 773, 774, or 775. In certain such embodiments, a short antisense compound targeted to nucleotides 1293-1324 of SEQ ID NO: 10 is selected from Isis No 372540, 372618, 382617, 372541, 372619, 372542, 372620, 372543, 372621, 372544, 372622, or 382618.

In certain embodiments, short antisense compounds targeted to a DGAT2 nucleic acid are 8 to 16, preferably 9 to 15, more preferably 9 to 14, more preferably 10 to 14 nucleotides in length. In certain embodiments, short antisense compounds targeted to a DGAT2 nucleic acid are 9 to 14 nucleotides in length. In certain embodiments, short antisense compounds targeted to a DGAT2 nucleic acid are 10 to 14 nucleotides in length. In certain embodiments, such short antisense compounds are short antisense oligonucleotides.

In certain embodiments, short antisense compounds targeted to a DGAT2 nucleic acid are short gapmers. In certain such embodiments, short gapmers targeted to a DGAT2 nucleic acid comprise at least one high affinity modification in one or more wings of the compound. In certain embodiments, short antisense compounds targeted to a DGAT2 nucleic acid comprise 1 to 3 high-affinity modifications in each wing. In certain such embodiments, the nucleosides or nucleotides of the wing comprise a 2' modification. In certain such embodiments, the monomers of the wing are BNA's. In certain such embodiments, the monomers of the wing are selected from α-L-Methyleneoxy (4'-CH$_2$—O-2') BNA, β-D-Methyleneoxy (4'-CH$_2$—O-2') BNA, Ethyleneoxy (4'-(CH$_2$)$_2$—O-2') BNA, Aminooxy (4'-CH$_2$—O—N(R)-2') BNA and Oxyamino (4'-CH$_2$—N(R)—O-2') BNA. In certain embodiments, the monomers of a wing comprise a substituent at the 2' position selected from allyl, amino, azido, thio, O-allyl, O—C$_1$-C$_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), and O—CH$_2$—C(═O)—N(R$_m$)(R$_n$), where each R$_m$ and R$_n$ is, independently, H or substituted or unsubstituted C$_1$-C$_{10}$ alkyl. In certain embodiments, the monomers of a wing are 2'MOE nucleotides.

In certain embodiments, short antisense compounds targeted to a DGAT2 nucleic acid comprise a gap between the 5' wing and the 3' wing. In certain embodiments the gap comprises five, six, seven, eight, nine, ten, eleven, twelve, thirteen, or fourteen monomers. In certain embodiments, the monomers of the gap are unmodified deoxyribonucleotides.

In certain embodiments, the monomers of the gap are unmodified ribonucleotides. In certain embodiments, gap modifications (if any) gap result in a short antisense compound that, when bound to its target nucleic acid, supports cleavage by an RNase, including, but not limited to, RNase H.

In certain embodiments, short antisense compounds targeted to a DGAT2 nucleic acid have uniform monomeric linkages. In certain such embodiments, those linkages are all phosphorothioate linkages. In certain embodiments, the linkages are all phosphodiester linkages. In certain embodiments, short antisense compounds targeted to a DGAT2 nucleic acid have mixed backbones.

In certain embodiments, short antisense compounds targeted to a DGAT2 nucleic acid are 8 monomers in length. In certain embodiments, short antisense compounds targeted to a DGAT2 nucleic acid are 9 monomers in length. In certain embodiments, short antisense compounds targeted to a DGAT2 nucleic acid are 10 monomers in length. In certain embodiments, short antisense compounds targeted to a DGAT2 nucleic acid are 11 monomers in length. In certain embodiments, short antisense compounds targeted to a DGAT2 nucleic acid are monomers in length. In certain embodiments, short antisense compounds targeted to a DGAT2 nucleic acid are 13 monomers in length. In certain embodiments, short antisense compounds targeted to a DGAT2 nucleic acid are 14 monomers in length. In certain embodiments, short antisense compounds targeted to a DGAT2 nucleic acid are 15 monomers in length. In certain embodiments, short antisense compounds targeted to a DGAT2 nucleic acid are 16 monomers in length. In certain embodiments, short antisense compounds targeted to a DGAT2 nucleic acid comprise 9 to 15 monomers. In certain embodiments, short antisense compounds targeted to a DGAT2 nucleic acid comprise 10 to 15 monomers. In certain embodiments, short antisense compounds targeted to a DGAT2 nucleic acid comprise 12 to 14 monomers. In certain embodiments, short antisense compounds targeted to a DGAT2 nucleic acid comprise 12 to 14 nucleotides or nucleosides.

In certain embodiments, the invention provides methods of modulating expression of DGAT2. In certain embodiments, such methods comprise use of one or more short antisense compound targeted to a DGAT2 nucleic acid, wherein the short antisense compound targeted to a DGAT2 nucleic acid is from about 8 to about 16, preferably 9 to 15, more preferably 9 to 14, more preferably 10 to 14 monomers (i.e. from about 8 to about 16 linked monomers). One of ordinary skill in the art will appreciate that this comprehends methods of modulating expression of DGAT2 using one or more short antisense compounds targeted to a DGAT2 nucleic acid of 8, 9, 10, 11, 12, 13, 14, 15 or 16 monomers.

In certain embodiments, methods of modulating DGAT2 comprise use of a short antisense compound targeted to a DGAT2 nucleic acid that is 8 monomers in length. In certain embodiments, methods of modulating DGAT2 comprise use of a short antisense compound targeted to a DGAT2 nucleic acid that is 9 monomers in length. In certain embodiments, methods of modulating DGAT2 comprise use of a short antisense compound targeted to a DGAT2 nucleic acid that is 10 monomers in length. In certain embodiments, methods of modulating DGAT2 comprise use of a short antisense compound targeted to a DGAT2 nucleic acid that is 11 monomers in length. In certain embodiments, methods of modulating DGAT2 comprise use of a short antisense compound targeted to a DGAT2 nucleic acid that is 12 monomers in length. In certain embodiments, methods of modulating DGAT2 comprise use of a short antisense compound targeted to a DGAT2 nucleic acid that is 13 monomers in length. In certain embodiments, methods of modulating DGAT2 comprise use of a short antisense compound targeted to a DGAT2 nucleic acid that is 14 monomers in length. In certain embodiments, methods of modulating DGAT2 comprise use of a short antisense compound targeted to a DGAT2 nucleic acid that is 15 monomers in length. In certain embodiments, methods of modulating DGAT2 comprise use of a short antisense compound targeted to a DGAT2 nucleic acid that is 16 monomers in length.

In certain embodiments, methods of modulating expression of DGAT2 comprise use of a short antisense compound targeted to a DGAT2 nucleic acid comprising 9 to 15 monomers. In certain embodiments, methods of modulating expression of DGAT2 comprise use of a short antisense compound targeted to a DGAT2 nucleic acid comprising 10 to 15 monomers. In certain embodiments, methods of modulating expression of DGAT2 comprise use of a short antisense compound targeted to a DGAT2 nucleic acid comprising 12 to 14 monomers. In certain embodiments, methods of modulating expression of DGAT2 comprise use of a short antisense compound targeted to a DGAT2 nucleic acid comprising 12 or 14 nucleotides or nucleosides.

9. PTP1B

PTP1B (also known as protein phosphatase 1B and PTPN1) is an endoplasmic reticulum (ER)-associated enzyme originally isolated as the major protein tyrosine phosphatase of the human placenta (Tonks et al., *J. Biol. Chem.*, 1988, 263, 6731-6737; Tonks et al., *J. Biol. Chem.*, 1988, 263, 6722-6730).

An essential regulatory role in signaling mediated by the insulin receptor has been established for PTP1B. In certain instances, PTP1B interacts with and dephosphorylates the activated insulin receptor both in vitro and in intact cells resulting in the downregulation of the signaling pathway (Goldstein et al., *Mol. Cell. Biochem.*, 1998, 182, 91-99; Seely et al., *Diabetes*, 1996, 45, 1379-1385). In addition, PTP1B modulates the mitogenic actions of insulin (Goldstein et al., *Mol. Cell. Biochem.*, 1998, 182, 91-99). In rat adipose cells overexpressing PTP1B, the translocation of the GLUT4 glucose transporter was inhibited, implicating PTP1B as a negative regulator of glucose transport as well (Chen et al., *J. Biol. Chem.*, 1997, 272, 8026-8031).

Mouse knockout models lacking the PTP1B gene also point toward the negative regulation of insulin signaling by PTP1B. Mice harboring a disrupted PTP1B gene showed increased insulin sensitivity and increased phosphorylation of the insulin receptor. When placed on a high-fat diet, PTP1B −/− mice were resistant to weight gain and remained insulin sensitive (Elchebly et al., *Science*, 1999, 283, 1544-1548). These studies clearly establish PTP1B as a therapeutic target in the treatment of diabetes and obesity.

Diabetes and obesity (sometimes now collectively referred to as "diabesity") are interrelated. Most human obesity is associated with insulin resistance and leptin resistance. In fact obesity may have an even greater impact on insulin action than does diabetes itself (Sindelka et al., *Physiol Res.*, 2002, 51, 85-91). Syndrome X or metabolic syndrome is a new term for a cluster of conditions, that, when occurring together, may indicate a predisposition to diabetes and cardiovascular disease. These symptoms, including high blood pressure, high triglycerides, decreased HDL and obesity, tend to appear together in some individuals. Because of its role in both diabetes and obesity, PTP1B is believed to be a therapeutic target for a range of metabolic conditions, including diabetes, obesity and metabolic syndrome. By improving blood glucose control, inhibitors of PTP1B may also be useful in slowing, preventing, delaying or ameliorating the sequelae of diabetes, which include retinopathy, neuropathy, cardiovascular complications and nephropathy.

PTP1B, which is differentially regulated during the cell cycle (Schievella et al., *Cell. Growth Differ.*, 1993, 4, 239-246), is expressed in insulin sensitive tissues as two different isoforms that arise from alternate splicing of the pre-mRNA (Shifrin and Neel, *J. Biol. Chem.*, 1993, 268, 25376-25384). The ratio of the alternatively spliced products is affected by growth factors, such as insulin, and differs in various tissues examined (Sell and Reese, *Mol. Genet. Metab.*, 1999, 66, 189-192). In these studies the levels of the variants correlated with the plasma insulin concentration and percentage body fat. These variants may therefore be used as a biomarker for patients with chronic hyperinsulinemia or type 2 diabetes.

Definitions

"Protein tyrosine phosphatase 1B" is the gene product or protein of which expression is to be modulated by administration of a short antisense compound. Protein tyrosine phosphatase 1B is generally referred to as PTP1B but may also be referred to as protein tyrosine phosphatase; PTPN1; RKPTP; protein tyrosine phosphatase, non-receptor type 1.

"PTP1B nucleic acid" means any nucleic acid encoding PTP1B. For example, in certain embodiments, a PTP1B nucleic acid includes, without limitation, a DNA sequence encoding PTP1B, an RNA sequence transcribed from DNA encoding PTP1B, and an mRNA sequence encoding PTP1B. "PTP1B mRNA" means an mRNA encoding a PTP1B protein.

Therapeutic Indications

Antisense technology is an effective means for reducing PTP1B expression and has proven to be uniquely useful in a number of therapeutic, diagnostic, and research applications. As such, in certain embodiments, the present invention provides compounds targeted to a nucleic acid encoding PTP1B, which modulate the expression of PTP1B. Further provided herein are short antisense compounds capable of effectively inhibiting PTP1B expression.

In certain therapeutics, a subject, suspected of having a disease or disorder which can be treated by modulating the expression of PTP1B is treated by administering one or more short antisense compounds targeted to a nucleic acid encoding PTP1B. For example, in one non-limiting embodiment, the methods comprise the step of administering to an animal a therapeutically effective amount of a short antisense compound. The short antisense compounds of the present invention effectively inhibit the activity of PTP1B or inhibit the expression of PTP1B. In one embodiment, the activity or expression of PTP1B in a subject is inhibited by at least 10%, by at least 20%, by at least 25%, by at least 30%, by at least 40%, by at least 50%, by at least 60%, by at least 70%, by at least 75%, by at least 80%, by at least 85%, by at least 90%, by at least 95%, by at least 98%, by at least 99%, or by 100%. In certain embodiments, activity or expression of PTP1B in a subject is inhibited by about 30%. In certain embodiments, the activity or expression of PTP1B in a subject is inhibited by 50% or more.

The reduction of the expression of PTP1B may be measured, for example, in blood, plasma, serum, adipose tissue, liver or any other body fluid, tissue or organ of the animal. Preferably, the cells contained within said fluids, tissues or organs being analyzed contain a nucleic acid molecule encoding PTP1B and/or the PTP1B protein itself.

Certain pharmaceutical and other compositions comprising the compounds of the invention are also provided. In certain embodiments short antisense compounds targeted to a PTP1B nucleic acid are utilized in pharmaceutical compositions by adding an effective amount of a compound to a suitable pharmaceutically acceptable diluent or carrier.

The short antisense compounds targeting PTP1B may have any one or more properties or characteristics of the short antisense compounds generally described herein. In certain embodiments, short antisense compounds targeting a PTP1B nucleic acid have a motif (wing-deoxy gap-wing) selected from 1-12-1, 1-1-10-2, 2-10-1-1, 3-10-3, 2-10-3, 2-10-2, 1-10-1, 1-10-2, 3-8-3, 2-8-2, 1-8-1, 3-6-3 or 1-6-1, more preferably 1-10-1, 2-10-2, 3-10-3, and 1-9-2.

In certain embodiments provided herein are methods of treating an individual by administering one or more short antisense compound targeted to a PTP1B nucleic acid or a pharmaceutical composition comprising such compound. Further provided are methods of treating a subject having a disease or conditions associated with PTP1B activity by administering a short antisense compound targeted to a PTP1B nucleic acid. Diseases and conditions associated with PTP1B include but are not limited to high blood glucose or hyperglycemia, prediabetes, diabetes, Type 2 diabetes, metabolic syndrome, obesity and insulin resistance. Therefore, provided herein are methods of treating to high blood glucose or hyperglycemia, prediabetes, diabetes, Type 2 diabetes, metabolic syndrome, obesity and insulin resistance by administering a short antisense compound targeted to a PTP1B nucleic acid.

In certain embodiments the present invention provides compositions and methods for decreasing blood glucose levels in a subject or for preventing or delaying the onset of a rise in blood glucose levels in a subject, by administering to the subject a short antisense inhibitor of PTP1B expression.

In certain embodiments, the present invention provides compositions and methods for improving insulin sensitivity in a subject or for preventing or delaying the onset of insulin resistance in a subject, by administering to the subject a short antisense inhibitor of PTP1B expression.

In certain embodiments, the present invention provides compositions and methods for treating a metabolic condition in a subject or for preventing or delaying the onset of a metabolic condition in a subject, by administering to the subject a short antisense compound targeted to a PTP1B nucleic acid. Such metabolic condition may be any metabolic condition associated with PTP1B expression, including but not limited to diabetes and obesity. Also provided are methods of reducing adiposity. Also provided is a method of treating obesity wherein metabolic rate is increased.

In certain embodiments, the subject has Type 2 diabetes. In certain embodiments the subject exhibits elevated HbA1c levels In certain embodiments, HbA1c levels are at least about 6%, at least about 7%, at least about 8%, at least about 9%, at least about 10% or at least about 11%. In preferred embodiments, $HbA_{1c}$ levels are reduced to about 7% or below about 7%. In certain embodiments, the subject exhibits an elevated body mass index In certain embodiments, the elevated body mass index is greater than 25 kg/m2. In certain embodiments, the subject exhibits hyperglycemia or elevated blood glucose levels. In a particular embodiment, the blood glucose levels are fasting blood glucose levels. In certain embodiments, the elevated fasting blood glucose levels are at least 130 mg/dL. In certain embodiments, the subject exhibits hyperglycemia prior to the start of treatment or exhibits fasting blood glucose levels above about 130 mg/dL, baseline HbA1c levels of at least about 7%, or body mass index of greater than 25 kg/m$^2$ or any combination thereof.

In certain embodiments a method of reducing one or more such levels by administering a short antisense compound targeted to a PTP1B nucleic acid is provided. For example, provided is a method of reducing fasting glucose levels, $HbA_{1c}$ levels or, body mass index levels or any combination thereof in a subject by administering to a subject a short antisense compound targeting PTP1B. Fasting glucose may be fasting blood glucose, fasting serum glucose, or fasting plasma glucose. In some embodiments, fasting plasma glucose levels are reduced by at least about 25 mg/dL or by at least about 10 mg/dL. In a certain embodiments, said subject does not achieve normal glucose levels on a therapeutic regimen of a glucose-lowering agent such as insulin, sulfonylurea, or metformin.

In certain embodiments the invention provides methods of altering lipid levels. Certain such methods reduce cholesterol, LDL and/or VLDL levels or any combination thereof in a subject by administering to the subject a short antisense compound targeted to a PTP1B nucleic acid. In certain embodiments HDL levels in a subject are increased by administering to the subject a short antisense compound targeted to a PTP1B nucleic acid. In certain embodiments, LDL:HDL ratio and/or total cholesterol:HDL ratio in a subject is reduced by administering to the subject a short antisense compound targeted to a PTP1B nucleic acid. In certain embodiments HDL:LDL ratio and/or HDL:total cholesterol ratio in a subject's increased by administering to the subject a short antisense compound targeted to a PTP1B nucleic acid. In certain embodiments lipid profile in a subject is improved by increasing HDL, lowering LDL, lowering VLDL, lowering triglycerides, lowering apolipoprotein B levels, or lowering total cholesterol levels, or a combination thereof, by administering to the subject a short antisense compound targeted to a PTP1B nucleic acid. In such embodiments, the subject is an animal, including a human.

Combination Therapy

In certain embodiments, one or more pharmaceutical compositions comprising a short antisense compound targeted to a PTP1B nucleic acid are co-administered with one or more other pharmaceutical agents. In certain embodiments, such one or more other pharmaceutical agents are designed to treat the same disease or condition as the one or more pharmaceutical compositions of the present invention. In certain embodiments, such one or more other pharmaceutical agents are designed to treat a different disease or condition as the one or more pharmaceutical compositions of the present invention. In certain embodiments, such one or more other pharmaceutical agents are designed to treat an undesired effect of one or more pharmaceutical compositions of the present invention. In certain embodiments, one or more pharmaceutical compositions of the present invention are co-administered with another pharmaceutical agent to treat an undesired effect of that other pharmaceutical agent. In certain embodiments, one or more pharmaceutical compositions of the present invention and one or more other pharmaceutical agents are administered at the same time. In certain embodiments, one or more pharmaceutical compositions of the present invention and one or more other pharmaceutical agents are administered at different times. In certain embodiments, one or more pharmaceutical compositions of the present invention and one or more other pharmaceutical agents are prepared together in a single formulation. In certain embodiments, one or more pharmaceutical compositions of the present invention and one or more other pharmaceutical agents are prepared separately.

In certain embodiments, pharmaceutical agents that may be co-administered with a pharmaceutical composition comprising a short antisense compound targeted to a PTP1B nucleic acid include glucose-lowering agents and therapies.

In some embodiments, the glucose-lowering agent is a PPAR agonist (gamma, dual, or pan), a dipeptidyl peptidase (IV) inhibitor, a GLP-1 analog, insulin or an insulin analog, an insulin secretagogue, a SGLT2 inhibitor, a human amylin analog, a biguanide, an alpha-glucosidase inhibitor, a meglitinide, a thiazolidinedione, or a sulfonylurea.

In some embodiments, the glucose-lowering therapeutic is a GLP-1 analog. In some embodiments, the GLP-1 analog is exendin-4 or liraglutide.

In other embodiments, the glucose-lowering therapeutic is a sulfonylurea. In some embodiments, the sulfonylurea is acetohexamide, chlorpropamide, tolbutamide, tolazamide, glimepiride, a glipizide, a glyburide, or a gliclazide.

In some embodiments, the glucose lowering drug is a biguanide. In some embodiments, the biguanide is metformin, and in some embodiments, blood glucose levels are decreased without increased lactic acidosis as compared to the lactic acidosis observed after treatment with metformin alone.

In some embodiments, the glucose lowering drug is a meglitinide. In some embodiments, the meglitinide is nateglinide or repaglinide.

In some embodiments, the glucose-lowering drug is a thiazolidinedione. In some embodiments, the thiazolidinedione is pioglitazone, rosiglitazone, or troglitazone. In some embodiments, blood glucose levels are decreased without greater weight gain than observed with rosiglitazone treatment alone.

In some embodiments, the glucose-lowering drug is an alpha-glucosidase inhibitor. In some embodiments, the alpha-glucosidase inhibitor is acarbose or miglitol.

In a certain embodiment, a co-administered glucose-lowering agent is ISIS 113715.

In a certain embodiment, glucose-lowering therapy is therapeutic lifestyle change.

In certain such embodiments, the glucose-lowering agent is administered prior to administration of a pharmaceutical composition of the present invention. In certain such embodiments, the glucose-lowering agent is administered following administration of a pharmaceutical composition of the present invention. In certain such embodiments the glucose-lowering agent is administered at the same time as a pharmaceutical composition of the present invention. In certain such embodiments the dose of a co-administered glucose-lowering agent is the same as the dose that would be administered if the glucose-lowering agent was administered alone. In certain such embodiments the dose of a co-administered glucose-lowering agent is lower than the dose that would be administered if the glucose-lowering agent was administered alone. In certain such embodiments the dose of a co-administered glucose-lowering agent is greater than the dose that would be administered if the glucose-lowering agent was administered alone.

In certain embodiments, pharmaceutical agents that may be co-administered with a pharmaceutical composition comprising a short antisense compound targeted to a PTP1B nucleic acid include lipid-lowering agents. Such lipid-lowering agents are discussed elsewhere in the application and are included here with respect to PTP1B. Such lipid lowering agents may be administered as described above for glucose lowering agents.

In certain embodiments, pharmaceutical agents that may be co-administered with a pharmaceutical composition comprising a short antisense compound targeted to a PTP1B nucleic acid include anti-obesity agents therapeutics. Such anti-obesity agents therapeutics may be administered as described above for glucose lowering agents.

Further provided is a method of administering a short antisense compound targeted to a PTP1B nucleic acid via injection and further including administering a topical steroid at the injection site.

Medicaments

Also provided herein are uses of a short antisense compound which is targeted to a PTP1B nucleic acid for the preparation of a medicament for reducing blood glucose levels including fasting glucose levels, and $HbA_{1c}$ levels, body mass index levels or any combination thereof. The medicament can be administered during a loading period and a maintenance period. In some embodiments, the medicament is administered subcutaneously or intravenously. In other embodiments, the administration of said medicament occurs at least once daily, at least once weekly, or at least once monthly. In a particular embodiment the short antisense compound present in the medicament is administered in a dose lower than a short antisense compound with a longer sequence and particularly a sequence 20 or more nucleobases. The medicament may be administered to a subject that exhibits high blood glucose or hyperglycemia, prediabetes, diabetes, Type 2 diabetes, metabolic syndrome, obesity and insulin resistance.

Other aspects and advantages of short antisense compounds are provided herein. All aspect and advantages disclosed herein and specifically with regard to other targets is applicable with regard to compositions including short antisense compounds targeted to a PTP1B nucleic acid and methods of their use.

Certain Short Antisense Compounds Targeted to a PTP1B Nucleic Acid

In certain embodiments, short antisense compounds are targeted to a PTP1B nucleic acid having the sequence of GENBANK® Accession No. NM_002827.2, incorporated herein as SEQ ID NO: 11 or the nucleotides 14178000 to 1425600 of the sequence of GENBANK® Accession No. NT_011362.9, incorporated herein as SEQ ID NO: 12. In certain such embodiments, a short antisense compound targeted to SEQ ID NO: 11 is at least 90% complementary to SEQ ID NO: 11. In certain such embodiments, a short antisense compound targeted to SEQ ID NO: 11 is at least 95% complementary to SEQ ID NO: 11. In certain such embodiments, a short antisense compound targeted to SEQ ID NO: 12 is 100% complementary to SEQ ID NO: 12. In certain such embodiments, a short antisense compound targeted to SEQ ID NO: 12 is at least 90% complementary to SEQ ID NO: 12. In certain such embodiments, a short antisense compound targeted to SEQ ID NO: 12 is at least 95% complementary to SEQ ID NO: 12. In certain such embodiments, a short antisense compound targeted to SEQ ID NO: 12 is 100% complementary to SEQ ID NO: 12.

In certain embodiments, a short antisense compound targeted to SEQ ID NO: 11 comprises a nucleotide sequence selected from the nucleotide sequences set forth in Tables 16 and 17. In certain embodiments, a short antisense compound targeted to SEQ ID NO: 12 comprises a nucleotide sequence selected from the nucleotide sequences set forth in Tables 18 and 19.

Each nucleotide sequence set forth in each Tables 16, 17, 18, and 19 is independent of any modification to a sugar moiety, an internucleoside linkage, or a nucleobase. As such, short antisense compounds comprising a nucleotide sequence as set forth in Tables 16, 17, 18, and 19 may comprise, independently, one or more modifications to a sugar moiety, an internucleoside linkage, or a nucleobase. Antisense compounds described by Isis Number (Isis NO.) indicate a combination of nucleobase sequence and one or more modifications to a sugar moiety, an internucleoside linkage, or a nucleobase.

Tables 16 and 17 illustrate examples of short antisense compounds targeted to SEQ ID NO: 11. Table 16 illustrates short antisense compounds that are 100% complementary to SEQ ID NO: 11. Table 17 illustrates short antisense compounds that have one or two mismatches with respect to SEQ ID NO: 11. Table 18 illustrates short antisense compounds that are 100% complementary to SEQ ID NO: 12. Table 19 illustrates short antisense compounds that have 1 or 2 mismatches with respect to SEQ ID NO: 12. The column labeled 'gapmer motif' indicates the wing-gap-wing motif of each short antisense compounds. The gap segment comprises 2'-deoxynucleotides and each nucleotide of each wing segment comprises a 2'-modified sugar. The particular 2'-modified sugar is also indicated in the 'gapmer motif' column. For example, '2-10-2 MOE' means a 2-10-2 gapmer motif, where a gap segment of ten 2'-deoxynucleotides is flanked by wing segments of two nucleotides, where the nucleotides of the wing segments are 2'-MOE nucleotides. Internucleoside linkages are phosphorothioate. The short antisense compounds comprise 5-methylcytidine in place of unmodified cytosine, unless "unmodified cytosine" is listed in the gapmer motif column, in which case the indicated cytosines are unmodified cytosines. For example, "5-mC in gap only" indicates that the gap segment has 5-methylcytosines, while the wing segments have unmodified cytosines.

TABLE 16

Short Antisense Compounds targeted to SEQ ID NO: 11

| ISIS NO. | 5' Target Site | 3' Target Site | Sequence (5'-3') | Gapmer Motif | SEQ ID NO |
|---|---|---|---|---|---|
| 147022 | 177 | 188 | TTGTCGATCTCC | 1-10-1 MOE | 886 |
| 147023 | 178 | 189 | CTTGTCGATCTC | 1-10-1 MOE | 859 |
| 147024 | 179 | 190 | CCTTGTCGATCT | 1-10-1 MOE | 853 |
| 147019 | 195 | 206 | TCGATCTCCTCG | 1-10-1 MOE | 877 |
| 147020 | 196 | 207 | GTCGATCTCCTC | 1-10-1 MOE | 868 |
| 147021 | 197 | 208 | TGTCGATCTCCT | 1-10-1 MOE | 882 |
| 147022 | 198 | 209 | TTGTCGATCTCC | 1-10-1 MOE | 886 |
| 147023 | 199 | 210 | CTTGTCGATCTC | 1-10-1 MOE | 859 |
| 147024 | 200 | 211 | CCTTGTCGATCT | 1-10-1 MOE | 853 |
| 147025 | 201 | 212 | GCCTTGTCGATC | 1-10-1 MOE | 865 |
| 147026 | 202 | 213 | AGCCTTGTCGAT | 1-10-1 MOE | 835 |
| 147027 | 203 | 214 | CAGCCTTGTCGA | 1-10-1 MOE | 843 |
| 147028 | 204 | 215 | CCAGCCTTGTCG | 1-10-1 MOE | 846 |
| 147073 | 204 | 215 | CACTGATCCTGC | 1-10-1 MOE | 842 |
| 147029 | 205 | 216 | CCCAGCCTTGTC | 1-10-1 MOE | 848 |
| 147030 | 206 | 217 | TCCCAGCCTTGT | 1-10-1 MOE | 874 |
| 147036 | 212 | 223 | CCCAGTTCCCAG | 1-10-1 MOE | 849 |
| 147037 | 213 | 224 | GCCCAGTTCCCA | 1-10-1 MOE | 863 |
| 147038 | 214 | 225 | CGCCCAGTTCCC | 1-10-1 MOE | 855 |

TABLE 16-continued

Short Antisense Compounds targeted to SEQ ID NO: 11

| ISIS NO. | 5' Target Site | 3' Target Site | Sequence (5'-3') | Gapmer Motif | SEQ ID NO |
|---|---|---|---|---|---|
| 147039 | 215 | 226 | CCGCCCAGTTCC | 1-10-1 MOE | 850 |
| 147040 | 216 | 227 | GCCGCCCAGTTC | 1-10-1 MOE | 864 |
| 147041 | 217 | 228 | AGCCGCCCAGTT | 1-10-1 MOE | 834 |
| 147073 | 311 | 322 | CACTGATCCTGC | 1-10-1 MOE | 842 |
| 147042 | 323 | 334 | GGTCAAAAGGGC | 1-10-1 MOE | 866 |
| 147043 | 324 | 335 | TGGTCAAAAGGG | 1-10-1 MOE | 881 |
| 147044 | 325 | 336 | GTGGTCAAAAGG | 1-10-1 MOE | 869 |
| 147045 | 326 | 337 | TGTGGTCAAAAG | 1-10-1 MOE | 883 |
| 147046 | 327 | 338 | CTGTGGTCAAAA | 1-10-1 MOE | 858 |
| 147047 | 328 | 339 | ACTGTGGTCAAA | 1-10-1 MOE | 833 |
| 147051 | 332 | 343 | TCCGACTGTGGT | 1-10-1 MOE | 875 |
| 147052 | 333 | 344 | ATCCGACTGTGG | 1-10-1 MOE | 837 |
| 147053 | 334 | 345 | AATCCGACTGTG | 1-10-1 MOE | 829 |
| 147054 | 335 | 346 | TAATCCGACTGT | 1-10-1 MOE | 871 |
| 147055 | 336 | 347 | TTAATCCGACTG | 1-10-1 MOE | 884 |
| 147056 | 337 | 348 | TTTAATCCGACT | 1-10-1 MOE | 887 |
| 147057 | 338 | 349 | ATTTAATCCGAC | 1-10-1 MOE | 839 |
| 147058 | 339 | 350 | AATTTAATCCGA | 1-10-1 MOE | 830 |
| 147059 | 340 | 351 | CAATTTAATCCG | 1-10-1 MOE | 840 |
| 147060 | 341 | 352 | GCAATTTAATCC | 1-10-1 MOE | 861 |
| 147061 | 342 | 353 | TGCAATTTAATC | 1-10-1 MOE | 879 |
| 147045 | 679 | 690 | TGTGGTCAAAAG | 1-10-1 MOE | 883 |
| 147046 | 680 | 691 | CTGTGGTCAAAA | 1-10-1 MOE | 858 |
| 147045 | 787 | 798 | TGTGGTCAAAAG | 1-10-1 MOE | 883 |
| 147046 | 788 | 799 | CTGTGGTCAAAA | 1-10-1 MOE | 858 |
| 147066 | 816 | 827 | CCTGCACTGACG | 1-10-1 MOE | 851 |
| 404131 | 992 | 1005 | ACCTTCGATCACAG | 2-10-2 MOE | 831 |
| 147062 | 1024 | 1035 | CACTGACGAGTC | 1-10-1 MOE | 841 |
| 147063 | 1025 | 1036 | GCACTGACGAGT | 1-10-1 MOE | 862 |
| 147064 | 1026 | 1037 | TGCACTGACGAG | 1-10-1 MOE | 880 |
| 147065 | 1027 | 1038 | CTGCACTGACGA | 1-10-1 MOE | 857 |
| 147066 | 1028 | 1039 | CCTGCACTGACG | 1-10-1 MOE | 851 |
| 147067 | 1029 | 1040 | TCCTGCACTGAC | 1-10-1 MOE | 876 |
| 147068 | 1030 | 1041 | ATCCTGCACTGA | 1-10-1 MOE | 838 |
| 147069 | 1031 | 1042 | GATCCTGCACTG | 1-10-1 MOE | 860 |
| 147070 | 1032 | 1043 | TGATCCTGCACT | 1-10-1 MOE | 878 |

TABLE 16-continued

Short Antisense Compounds targeted to SEQ ID NO: 11

| ISIS NO. | 5' Target Site | 3' Target Site | Sequence (5'-3') | Gapmer Motif | SEQ ID NO |
|---|---|---|---|---|---|
| 147071 | 1033 | 1044 | CTGATCCTGCAC | 1-10-1 MOE | 856 |
| 147072 | 1034 | 1045 | ACTGATCCTGCA | 1-10-1 MOE | 832 |
| 147073 | 1035 | 1046 | CACTGATCCTGC | 1-10-1 MOE | 842 |
| 147067 | 1199 | 1210 | TCCTGCACTGAC | 1-10-1 MOE | 876 |
| 147040 | 1288 | 1299 | GCCGCCCAGTTC | 1-10-1 MOE | 864 |
| 147040 | 1396 | 1407 | GCCGCCCAGTTC | 1-10-1 MOE | 864 |
| 147022 | 1868 | 1879 | TTGTCGATCTCC | 1-10-1 MOE | 886 |
| 147023 | 1869 | 1880 | CTTGTCGATCTC | 1-10-1 MOE | 859 |
| 147024 | 1870 | 1881 | CCTTGTCGATCT | 1-10-1 MOE | 853 |
| 147019 | 1886 | 1897 | TCGATCTCCTCG | 1-10-1 MOE | 877 |
| 147020 | 1887 | 1898 | GTCGATCTCCTC | 1-10-1 MOE | 868 |
| 147021 | 1888 | 1899 | TGTCGATCTCCT | 1-10-1 MOE | 882 |
| 147022 | 1889 | 1900 | TTGTCGATCTCC | 1-10-1 MOE | 886 |
| 147023 | 1890 | 1901 | CTTGTCGATCTC | 1-10-1 MOE | 859 |
| 147025 | 1892 | 1903 | GCCTTGTCGATC | 1-10-1 MOE | 865 |
| 147027 | 1894 | 1905 | CAGCCTTGTCGA | 1-10-1 MOE | 843 |
| 147028 | 1895 | 1906 | CCAGCCTTGTCG | 1-10-1 MOE | 846 |
| 147030 | 1897 | 1908 | TCCCAGCCTTGT | 1-10-1 MOE | 874 |
| 147037 | 1904 | 1915 | GCCCAGTTCCCA | 1-10-1 MOE | 863 |
| 147038 | 1905 | 1916 | CGCCCAGTTCCC | 1-10-1 MOE | 855 |
| 147040 | 1907 | 1918 | GCCGCCCAGTTC | 1-10-1 MOE | 864 |
| 147041 | 1908 | 1919 | AGCCGCCCAGTT | 1-10-1 MOE | 834 |
| 147022 | 1976 | 1987 | TTGTCGATCTCC | 1-10-1 MOE | 886 |
| 147023 | 1977 | 1988 | CTTGTCGATCTC | 1-10-1 MOE | 859 |
| 147024 | 1978 | 1989 | CCTTGTCGATCT | 1-10-1 MOE | 853 |
| 147020 | 1995 | 2006 | GTCGATCTCCTC | 1-10-1 MOE | 868 |
| 147021 | 1996 | 2007 | TGTCGATCTCCT | 1-10-1 MOE | 882 |
| 147022 | 1997 | 2008 | TTGTCGATCTCC | 1-10-1 MOE | 886 |
| 147023 | 1998 | 2009 | CTTGTCGATCTC | 1-10-1 MOE | 859 |
| 147024 | 1999 | 2010 | CCTTGTCGATCT | 1-10-1 MOE | 853 |
| 147025 | 2000 | 2011 | GCCTTGTCGATC | 1-10-1 MOE | 865 |
| 147026 | 2001 | 2012 | AGCCTTGTCGAT | 1-10-1 MOE | 835 |
| 147027 | 2002 | 2013 | CAGCCTTGTCGA | 1-10-1 MOE | 843 |
| 147028 | 2003 | 2014 | CCAGCCTTGTCG | 1-10-1 MOE | 846 |
| 147029 | 2004 | 2015 | CCCAGCCTTGTC | 1-10-1 MOE | 848 |
| 147030 | 2005 | 2016 | TCCCAGCCTTGT | 1-10-1 MOE | 874 |
| 147036 | 2011 | 2022 | CCCAGTTCCCAG | 1-10-1 MOE | 849 |
| 147037 | 2012 | 2023 | GCCCAGTTCCCA | 1-10-1 MOE | 863 |
| 147038 | 2013 | 2024 | CGCCCAGTTCCC | 1-10-1 MOE | 855 |
| 147039 | 2014 | 2025 | CCGCCCAGTTCC | 1-10-1 MOE | 850 |
| 147040 | 2015 | 2026 | GCCGCCCAGTTC | 1-10-1 MOE | 864 |
| 147041 | 2016 | 2027 | AGCCGCCCAGTT | 1-10-1 MOE | 834 |
| 404199 | 2366 | 2379 | GGTCATGCACAGGC | 2-10-2 MOE | 867 |
| 404134 | 2369 | 2382 | TCAGGTCATGCACA | 2-10-2 MOE | 873 |
| 404132 | 2548 | 2561 | CCTTGGAATGTCTG | 2-10-2 MOE | 852 |
| 147020 | 2613 | 2624 | GTCGATCTCCTC | 1-10-1 MOE | 868 |
| 147020 | 2721 | 2732 | GTCGATCTCCTC | 1-10-1 MOE | 868 |
| 404133 | 3289 | 3302 | TATTCCATGGCCAT | 2-10-2 MOE | 872 |
| 147032 | 6220 | 6231 | GTTCCCAGCCTT | 1-10-1 MOE | 870 |
| 147033 | 6221 | 6232 | AGTTCCCAGCCT | 1-10-1 MOE | 836 |
| 147034 | 6222 | 6233 | CAGTTCCCAGCC | 1-10-1 MOE | 844 |
| 147044 | 6288 | 6299 | GTGGTCAAAAGG | 1-10-1 MOE | 869 |
| 147045 | 6289 | 6300 | TGTGGTCAAAAG | 1-10-1 MOE | 883 |
| 147032 | 6329 | 6340 | GTTCCCAGCCTT | 1-10-1 MOE | 870 |
| 147033 | 6330 | 6341 | AGTTCCCAGCCT | 1-10-1 MOE | 836 |
| 147034 | 6331 | 6342 | CAGTTCCCAGCC | 1-10-1 MOE | 844 |
| 147044 | 6397 | 6408 | GTGGTCAAAAGG | 1-10-1 MOE | 869 |
| 147045 | 6398 | 6409 | TGTGGTCAAAAG | 1-10-1 MOE | 883 |
| 147058 | 7057 | 7068 | AATTTAATCCGA | 1-10-1 MOE | 830 |
| 147059 | 7058 | 7069 | CAATTTAATCCG | 1-10-1 MOE | 840 |
| 147060 | 7059 | 7070 | GCAATTTAATCC | 1-10-1 MOE | 861 |
| 147058 | 7166 | 7177 | AATTTAATCCGA | 1-10-1 MOE | 830 |
| 147059 | 7167 | 7178 | CAATTTAATCCG | 1-10-1 MOE | 840 |
| 147041 | 8084 | 8095 | AGCCGCCCAGTT | 1-10-1 MOE | 834 |
| 147041 | 8192 | 8203 | AGCCGCCCAGTT | 1-10-1 MOE | 834 |
| 147027 | 8630 | 8641 | CAGCCTTGTCGA | 1-10-1 MOE | 843 |
| 147028 | 8631 | 8642 | CCAGCCTTGTCG | 1-10-1 MOE | 846 |
| 147027 | 8738 | 8749 | CAGCCTTGTCGA | 1-10-1 MOE | 843 |
| 147028 | 8739 | 8750 | CCAGCCTTGTCG | 1-10-1 MOE | 846 |
| 147043 | 10957 | 10968 | TGGTCAAAGGG | 1-10-1 MOE | 881 |
| 147044 | 10958 | 10969 | GTGGTCAAAAGG | 1-10-1 MOE | 869 |
| 147043 | 11065 | 11076 | TGGTCAAAGGG | 1-10-1 MOE | 881 |

TABLE 16-continued

Short Antisense Compounds targeted to SEQ ID NO: 11

| ISIS NO. | 5' Target Site | 3' Target Site | Sequence (5'-3') | Gapmer Motif | SEQ ID NO |
|---|---|---|---|---|---|
| 147044 | 11066 | 11077 | GTGGTCAAAAGG | 1-10-1 MOE | 869 |
| 147071 | 11605 | 11616 | CTGATCCTGCAC | 1-10-1 MOE | 856 |
| 147070 | 11611 | 11622 | TGATCCTGCACT | 1-10-1 MOE | 878 |
| 147071 | 11612 | 11623 | CTGATCCTGCAC | 1-10-1 MOE | 856 |
| 147072 | 12294 | 12305 | ACTGATCCTGCA | 1-10-1 MOE | 832 |
| 147072 | 12299 | 12310 | ACTGATCCTGCA | 1-10-1 MOE | 832 |
| 147030 | 12805 | 12816 | TCCCAGCCTTGT | 1-10-1 MOE | 874 |
| 147031 | 12806 | 12817 | TTCCCAGCCTTG | 1-10-1 MOE | 885 |
| 147053 | 12939 | 12950 | AATCCGACTGTG | 1-10-1 MOE | 829 |
| 147030 | 12986 | 12997 | TCCCAGCCTTGT | 1-10-1 MOE | 874 |
| 147031 | 12987 | 12998 | TTCCCAGCCTTG | 1-10-1 MOE | 885 |
| 147053 | 13120 | 13131 | AATCCGACTGTG | 1-10-1 MOE | 829 |
| 147051 | 13162 | 13173 | TCCGACTGTGGT | 1-10-1 MOE | 875 |
| 147061 | 13316 | 13327 | TGCAATTTAATC | 1-10-1 MOE | 879 |
| 147047 | 13339 | 13350 | ACTGTGGTCAAA | 1-10-1 MOE | 833 |
| 147029 | 14058 | 14069 | CCCAGCCTTGTC | 1-10-1 MOE | 848 |
| 147029 | 14239 | 14250 | CCCAGCCTTGTC | 1-10-1 MOE | 848 |
| 147067 | 15560 | 15571 | TCCTGCACTGAC | 1-10-1 MOE | 876 |
| 147068 | 15561 | 15572 | ATCCTGCACTGA | 1-10-1 MOE | 838 |
| 147067 | 15742 | 15753 | TCCTGCACTGAC | 1-10-1 MOE | 876 |
| 147069 | 15744 | 15755 | GATCCTGCACTG | 1-10-1 MOE | 860 |
| 147042 | 16561 | 16572 | GGTCAAAAGGGC | 1-10-1 MOE | 866 |
| 147042 | 16727 | 16738 | GGTCAAAAGGGC | 1-10-1 MOE | 866 |
| 147030 | 17619 | 17630 | TCCCAGCCTTGT | 1-10-1 MOE | 874 |
| 147064 | 17762 | 17773 | TGCACTGACGAG | 1-10-1 MOE | 880 |
| 147030 | 17787 | 17798 | TCCCAGCCTTGT | 1-10-1 MOE | 874 |
| 147064 | 17930 | 17941 | TGCACTGACGAG | 1-10-1 MOE | 880 |
| 147042 | 19201 | 19212 | GGTCAAAAGGGC | 1-10-1 MOE | 866 |
| 147042 | 19369 | 19380 | GGTCAAAAGGGC | 1-10-1 MOE | 866 |
| 147027 | 21190 | 21201 | CAGCCTTGTCGA | 1-10-1 MOE | 843 |
| 147028 | 21191 | 21202 | CCAGCCTTGTCG | 1-10-1 MOE | 846 |
| 147027 | 21358 | 21369 | CAGCCTTGTCGA | 1-10-1 MOE | 843 |
| 147028 | 21359 | 21370 | CCAGCCTTGTCG | 1-10-1 MOE | 846 |
| 147070 | 22021 | 22032 | TGATCCTGCACT | 1-10-1 MOE | 878 |
| 147070 | 22189 | 22200 | TGATCCTGCACT | 1-10-1 MOE | 878 |
| 147047 | 22606 | 22617 | ACTGTGGTCAAA | 1-10-1 MOE | 833 |
| 147043 | 24318 | 24329 | TGGTCAAAAGGG | 1-10-1 MOE | 881 |
| 147044 | 24319 | 24330 | GTGGTCAAAAGG | 1-10-1 MOE | 869 |
| 147045 | 24320 | 24331 | TGTGGTCAAAAG | 1-10-1 MOE | 883 |
| 147046 | 24321 | 24332 | CTGTGGTCAAAA | 1-10-1 MOE | 858 |
| 147043 | 24486 | 24497 | TGGTCAAAAGGG | 1-10-1 MOE | 881 |
| 147044 | 24487 | 24498 | GTGGTCAAAAGG | 1-10-1 MOE | 869 |
| 147046 | 24489 | 24500 | CTGTGGTCAAAA | 1-10-1 MOE | 858 |
| 147047 | 24490 | 24501 | ACTGTGGTCAAA | 1-10-1 MOE | 833 |
| 147040 | 25065 | 25076 | GCCGCCCAGTTC | 1-10-1 MOE | 864 |
| 147041 | 25066 | 25077 | AGCCGCCCAGTT | 1-10-1 MOE | 834 |
| 147046 | 25160 | 25171 | CTGTGGTCAAAA | 1-10-1 MOE | 858 |
| 147039 | 25232 | 25243 | CCGCCCAGTTCC | 1-10-1 MOE | 850 |
| 147040 | 25233 | 25244 | GCCGCCCAGTTC | 1-10-1 MOE | 864 |
| 147041 | 25234 | 25245 | AGCCGCCCAGTT | 1-10-1 MOE | 834 |
| 147046 | 25328 | 25339 | CTGTGGTCAAAA | 1-10-1 MOE | 858 |
| 147057 | 25508 | 25519 | ATTTAATCCGAC | 1-10-1 MOE | 839 |
| 147061 | 25512 | 25523 | TGCAATTTAATC | 1-10-1 MOE | 879 |
| 147057 | 25676 | 25687 | ATTTAATCCGAC | 1-10-1 MOE | 839 |
| 147069 | 28878 | 28889 | GATCCTGCACTG | 1-10-1 MOE | 860 |
| 147070 | 28879 | 28890 | TGATCCTGCACT | 1-10-1 MOE | 878 |
| 147053 | 30133 | 30144 | AATCCGACTGTG | 1-10-1 MOE | 829 |
| 147053 | 30278 | 30289 | AATCCGACTGTG | 1-10-1 MOE | 829 |
| 147054 | 30864 | 30875 | TAATCCGACTGT | 1-10-1 MOE | 871 |
| 147043 | 30985 | 30996 | TGGTCAAAAGGG | 1-10-1 MOE | 881 |
| 147054 | 31011 | 31022 | TAATCCGACTGT | 1-10-1 MOE | 871 |
| 147043 | 31133 | 31144 | TGGTCAAAAGGG | 1-10-1 MOE | 881 |
| 147036 | 32233 | 32244 | CCCAGTTCCCAG | 1-10-1 MOE | 849 |
| 147072 | 32372 | 32383 | ACTGATCCTGCA | 1-10-1 MOE | 832 |
| 147072 | 32520 | 32531 | ACTGATCCTGCA | 1-10-1 MOE | 832 |
| 147069 | 33056 | 33067 | GATCCTGCACTG | 1-10-1 MOE | 860 |
| 147070 | 33057 | 33068 | TGATCCTGCACT | 1-10-1 MOE | 878 |
| 147071 | 33058 | 33069 | CTGATCCTGCAC | 1-10-1 MOE | 856 |
| 147051 | 33126 | 33137 | TCCGACTGTGGT | 1-10-1 MOE | 875 |
| 147070 | 33205 | 33216 | TGATCCTGCACT | 1-10-1 MOE | 878 |
| 147071 | 33206 | 33217 | CTGATCCTGCAC | 1-10-1 MOE | 856 |
| 147051 | 33274 | 33285 | TCCGACTGTGGT | 1-10-1 MOE | 875 |

TABLE 16-continued

Short Antisense Compounds targeted to SEQ ID NO: 11

| ISIS NO. | 5' Target Site | 3' Target Site | Sequence (5'-3') | Gapmer Motif | SEQ ID NO |
|---|---|---|---|---|---|
| 147046 | 33318 | 33329 | CTGTGGTCAAAA | 1-10-1 MOE | 858 |
| 147049 | 33321 | 33332 | CGACTGTGGTCA | 1-10-1 MOE | 854 |
| 147051 | 33323 | 33334 | TCCGACTGTGGT | 1-10-1 MOE | 875 |
| 147046 | 33466 | 33477 | CTGTGGTCAAAA | 1-10-1 MOE | 858 |
| 147047 | 33467 | 33478 | ACTGTGGTCAAA | 1-10-1 MOE | 833 |
| 147051 | 33471 | 33482 | TCCGACTGTGGT | 1-10-1 MOE | 875 |
| 147046 | 33640 | 33651 | CTGTGGTCAAAA | 1-10-1 MOE | 858 |
| 147051 | 33645 | 33656 | TCCGACTGTGGT | 1-10-1 MOE | 875 |
| 147046 | 33788 | 33799 | CTGTGGTCAAAA | 1-10-1 MOE | 858 |
| 147051 | 33793 | 33804 | TCCGACTGTGGT | 1-10-1 MOE | 875 |
| 147059 | 35437 | 35448 | CAATTTAATCCG | 1-10-1 MOE | 840 |
| 147060 | 35438 | 35449 | GCAATTTAATCC | 1-10-1 MOE | 861 |
| 147060 | 35586 | 35597 | GCAATTTAATCC | 1-10-1 MOE | 861 |
| 147021 | 36093 | 36104 | TGTCGATCTCCT | 1-10-1 MOE | 882 |
| 147061 | 36250 | 36261 | TGCAATTTAATC | 1-10-1 MOE | 879 |
| 147061 | 36398 | 36409 | TGCAATTTAATC | 1-10-1 MOE | 879 |
| 147073 | 37485 | 37496 | CACTGATCCTGC | 1-10-1 MOE | 842 |
| 147073 | 37633 | 37644 | CACTGATCCTGC | 1-10-1 MOE | 842 |
| 147043 | 40214 | 40225 | TGGTCAAAAGGG | 1-10-1 MOE | 881 |
| 147061 | 40353 | 40364 | TGCAATTTAATC | 1-10-1 MOE | 879 |
| 147043 | 40362 | 40373 | TGGTCAAAAGGG | 1-10-1 MOE | 881 |
| 147061 | 40501 | 40512 | TGCAATTTAATC | 1-10-1 MOE | 879 |
| 147031 | 42527 | 42538 | TTCCCAGCCTTG | 1-10-1 MOE | 885 |
| 147032 | 42528 | 42539 | GTTCCCAGCCTT | 1-10-1 MOE | 870 |
| 147034 | 42530 | 42541 | CAGTTCCCAGCC | 1-10-1 MOE | 844 |
| 147031 | 42675 | 42686 | TTCCCAGCCTTG | 1-10-1 MOE | 885 |
| 147032 | 42676 | 42687 | GTTCCCAGCCTT | 1-10-1 MOE | 870 |
| 147033 | 42677 | 42688 | AGTTCCCAGCCT | 1-10-1 MOE | 836 |
| 147034 | 42678 | 42689 | CAGTTCCCAGCC | 1-10-1 MOE | 844 |
| 147074 | 43848 | 43859 | CCACTGATCCTG | 1-10-1 MOE | 845 |
| 147074 | 43996 | 44007 | CCACTGATCCTG | 1-10-1 MOE | 845 |
| 147051 | 45402 | 45413 | TCCGACTGTGGT | 1-10-1 MOE | 875 |
| 147051 | 45550 | 45561 | TCCGACTGTGGT | 1-10-1 MOE | 875 |
| 147074 | 46125 | 46136 | CCACTGATCCTG | 1-10-1 MOE | 845 |
| 147057 | 46313 | 46324 | ATTTAATCCGAC | 1-10-1 MOE | 839 |
| 147058 | 46314 | 46325 | AATTTAATCCGA | 1-10-1 MOE | 830 |
| 147059 | 46315 | 46326 | CAATTTAATCCG | 1-10-1 MOE | 840 |
| 147061 | 46317 | 46328 | TGCAATTTAATC | 1-10-1 MOE | 879 |
| 147057 | 46461 | 46472 | ATTTAATCCGAC | 1-10-1 MOE | 839 |
| 147059 | 46463 | 46474 | CAATTTAATCCG | 1-10-1 MOE | 840 |
| 147061 | 46465 | 46476 | TGCAATTTAATC | 1-10-1 MOE | 879 |
| 147058 | 47413 | 47424 | AATTTAATCCGA | 1-10-1 MOE | 830 |
| 147073 | 48221 | 48232 | CACTGATCCTGC | 1-10-1 MOE | 842 |
| 147073 | 48369 | 48380 | CACTGATCCTGC | 1-10-1 MOE | 842 |
| 147074 | 48370 | 48381 | CCACTGATCCTG | 1-10-1 MOE | 845 |
| 147027 | 48566 | 48577 | CAGCCTTGTCGA | 1-10-1 MOE | 843 |
| 147027 | 48714 | 48725 | CAGCCTTGTCGA | 1-10-1 MOE | 843 |
| 147028 | 48715 | 48726 | CCAGCCTTGTCG | 1-10-1 MOE | 846 |
| 147067 | 49050 | 49061 | TCCTGCACTGAC | 1-10-1 MOE | 876 |
| 147068 | 49051 | 49062 | ATCCTGCACTGA | 1-10-1 MOE | 838 |
| 147067 | 49198 | 49209 | TCCTGCACTGAC | 1-10-1 MOE | 876 |
| 147073 | 49524 | 49535 | CACTGATCCTGC | 1-10-1 MOE | 842 |
| 147073 | 49672 | 49683 | CACTGATCCTGC | 1-10-1 MOE | 842 |
| 147074 | 49673 | 49684 | CCACTGATCCTG | 1-10-1 MOE | 845 |
| 147036 | 50421 | 50432 | CCCAGTTCCCAG | 1-10-1 MOE | 849 |
| 147036 | 52292 | 52303 | CCCAGTTCCCAG | 1-10-1 MOE | 849 |
| 147037 | 52293 | 52304 | GCCCAGTTCCCA | 1-10-1 MOE | 863 |
| 147036 | 52438 | 52449 | CCCAGTTCCCAG | 1-10-1 MOE | 849 |
| 147037 | 52439 | 52450 | GCCCAGTTCCCA | 1-10-1 MOE | 863 |
| 147034 | 53148 | 53159 | CAGTTCCCAGCC | 1-10-1 MOE | 844 |
| 147034 | 53294 | 53305 | CAGTTCCCAGCC | 1-10-1 MOE | 844 |
| 147042 | 53445 | 53456 | GGTCAAAGGGC | 1-10-1 MOE | 866 |
| 147043 | 53446 | 53457 | TGGTCAAAAGGG | 1-10-1 MOE | 881 |
| 147044 | 53447 | 53458 | GTGGTCAAAAGG | 1-10-1 MOE | 869 |
| 147042 | 53591 | 53602 | GGTCAAAGGGC | 1-10-1 MOE | 866 |
| 147030 | 53592 | 53603 | TCCCAGCCTTGT | 1-10-1 MOE | 874 |
| 147043 | 53592 | 53603 | TGGTCAAAAGGG | 1-10-1 MOE | 881 |
| 147031 | 53593 | 53604 | TTCCCAGCCTTG | 1-10-1 MOE | 885 |
| 147044 | 53593 | 53604 | GTGGTCAAAAGG | 1-10-1 MOE | 869 |
| 147030 | 53738 | 53749 | TCCCAGCCTTGT | 1-10-1 MOE | 874 |
| 147031 | 53739 | 53750 | TTCCCAGCCTTG | 1-10-1 MOE | 885 |
| 147040 | 53783 | 53794 | GCCGCCCAGTTC | 1-10-1 MOE | 864 |

TABLE 16-continued

Short Antisense Compounds targeted to SEQ ID NO: 11

| ISIS NO. | 5' Target Site | 3' Target Site | Sequence (5'-3') | Gapmer Motif | SEQ ID NO |
|---|---|---|---|---|---|
| 147041 | 53784 | 53795 | AGCCGCCCAGTT | 1-10-1 MOE | 834 |
| 147041 | 53930 | 53941 | AGCCGCCCAGTT | 1-10-1 MOE | 834 |
| 147042 | 55008 | 55019 | GGTCAAAAGGGC | 1-10-1 MOE | 866 |
| 147043 | 55009 | 55020 | TGGTCAAAAGGG | 1-10-1 MOE | 881 |
| 147042 | 55154 | 55165 | GGTCAAAAGGGC | 1-10-1 MOE | 866 |
| 147043 | 55155 | 55166 | TGGTCAAAAGGG | 1-10-1 MOE | 881 |
| 147058 | 55281 | 55292 | AATTTAATCCGA | 1-10-1 MOE | 830 |
| 147058 | 55427 | 55438 | AATTTAATCCGA | 1-10-1 MOE | 830 |
| 147019 | 55682 | 55693 | TCGATCTCCTCG | 1-10-1 MOE | 877 |
| 147021 | 55684 | 55695 | TGTCGATCTCCT | 1-10-1 MOE | 882 |
| 147021 | 55830 | 55841 | TGTCGATCTCCT | 1-10-1 MOE | 882 |
| 147054 | 56275 | 56286 | TAATCCGACTGT | 1-10-1 MOE | 871 |
| 147055 | 56276 | 56287 | TTAATCCGACTG | 1-10-1 MOE | 884 |
| 147056 | 56277 | 56288 | TTTAATCCGACT | 1-10-1 MOE | 887 |
| 147058 | 56279 | 56290 | AATTTAATCCGA | 1-10-1 MOE | 830 |
| 147059 | 56280 | 56291 | CAATTTAATCCG | 1-10-1 MOE | 840 |
| 147060 | 56281 | 56292 | GCAATTTAATCC | 1-10-1 MOE | 861 |
| 147061 | 56282 | 56293 | TGCAATTTAATC | 1-10-1 MOE | 879 |
| 147051 | 56418 | 56429 | TCCGACTGTGGT | 1-10-1 MOE | 875 |
| 147053 | 56420 | 56431 | AATCCGACTGTG | 1-10-1 MOE | 829 |
| 147054 | 56421 | 56432 | TAATCCGACTGT | 1-10-1 MOE | 871 |
| 147055 | 56422 | 56433 | TTAATCCGACTG | 1-10-1 MOE | 884 |
| 147056 | 56423 | 56434 | TTTAATCCGACT | 1-10-1 MOE | 887 |
| 147057 | 56424 | 56435 | ATTTAATCCGAC | 1-10-1 MOE | 839 |
| 147058 | 56425 | 56436 | AATTTAATCCGA | 1-10-1 MOE | 830 |
| 147061 | 56428 | 56439 | TGCAATTTAATC | 1-10-1 MOE | 879 |
| 147045 | 57118 | 57129 | TGTGGTCAAAAG | 1-10-1 MOE | 883 |
| 147045 | 57264 | 57275 | TGTGGTCAAAAG | 1-10-1 MOE | 883 |
| 147046 | 57265 | 57276 | CTGTGGTCAAAA | 1-10-1 MOE | 858 |
| 147071 | 58028 | 58039 | CTGATCCTGCAC | 1-10-1 MOE | 856 |
| 147071 | 58174 | 58185 | CTGATCCTGCAC | 1-10-1 MOE | 856 |
| 147043 | 61111 | 61122 | TGGTCAAAAGGG | 1-10-1 MOE | 881 |
| 147071 | 61130 | 61141 | CTGATCCTGCAC | 1-10-1 MOE | 856 |
| 147020 | 61226 | 61237 | GTCGATCTCCTC | 1-10-1 MOE | 868 |
| 147043 | 61257 | 61268 | TGGTCAAAAGGG | 1-10-1 MOE | 881 |
| 147071 | 61276 | 61287 | CTGATCCTGCAC | 1-10-1 MOE | 856 |
| 147035 | 61277 | 61288 | CCAGTTCCCAGC | 1-10-1 MOE | 847 |
| 147036 | 61278 | 61289 | CCCAGTTCCCAG | 1-10-1 MOE | 849 |
| 147037 | 61279 | 61290 | GCCCAGTTCCCA | 1-10-1 MOE | 863 |
| 147038 | 61280 | 61291 | CGCCCAGTTCCC | 1-10-1 MOE | 855 |
| 147039 | 61281 | 61292 | CCGCCCAGTTCC | 1-10-1 MOE | 850 |
| 147040 | 61282 | 61293 | GCCGCCCAGTTC | 1-10-1 MOE | 864 |
| 147071 | 61309 | 61320 | CTGATCCTGCAC | 1-10-1 MOE | 856 |
| 147020 | 61372 | 61383 | GTCGATCTCCTC | 1-10-1 MOE | 868 |
| 147034 | 61422 | 61433 | CAGTTCCCAGCC | 1-10-1 MOE | 844 |
| 147035 | 61423 | 61434 | CCAGTTCCCAGC | 1-10-1 MOE | 847 |
| 147036 | 61424 | 61435 | CCCAGTTCCCAG | 1-10-1 MOE | 849 |
| 147037 | 61425 | 61436 | GCCCAGTTCCCA | 1-10-1 MOE | 863 |
| 147038 | 61426 | 61437 | CGCCCAGTTCCC | 1-10-1 MOE | 855 |
| 147040 | 61428 | 61439 | GCCGCCCAGTTC | 1-10-1 MOE | 864 |
| 147071 | 61455 | 61466 | CTGATCCTGCAC | 1-10-1 MOE | 856 |
| 147073 | 62003 | 62014 | CACTGATCCTGC | 1-10-1 MOE | 842 |
| 147073 | 62149 | 62160 | CACTGATCCTGC | 1-10-1 MOE | 842 |
| 147066 | 63065 | 63076 | CCTGCACTGACG | 1-10-1 MOE | 851 |
| 147068 | 63067 | 63078 | ATCCTGCACTGA | 1-10-1 MOE | 838 |
| 147069 | 63146 | 63157 | GATCCTGCACTG | 1-10-1 MOE | 860 |
| 147062 | 63207 | 63218 | CACTGACGAGTC | 1-10-1 MOE | 841 |
| 147066 | 63211 | 63222 | CCTGCACTGACG | 1-10-1 MOE | 851 |
| 147057 | 64054 | 64065 | ATTTAATCCGAC | 1-10-1 MOE | 839 |
| 147036 | 64538 | 64549 | CCCAGTTCCCAG | 1-10-1 MOE | 849 |
| 147037 | 64539 | 64550 | GCCCAGTTCCCA | 1-10-1 MOE | 863 |
| 147037 | 64685 | 64696 | GCCCAGTTCCCA | 1-10-1 MOE | 863 |
| 147066 | 64864 | 64875 | CCTGCACTGACG | 1-10-1 MOE | 851 |
| 147067 | 64865 | 64876 | TCCTGCACTGAC | 1-10-1 MOE | 876 |
| 147066 | 65010 | 65021 | CCTGCACTGACG | 1-10-1 MOE | 851 |
| 147067 | 65011 | 65022 | TCCTGCACTGAC | 1-10-1 MOE | 876 |
| 147045 | 65017 | 65028 | TGTGGTCAAAAG | 1-10-1 MOE | 883 |
| 147045 | 65163 | 65174 | TGTGGTCAAAAG | 1-10-1 MOE | 883 |
| 147046 | 65164 | 65175 | CTGTGGTCAAAA | 1-10-1 MOE | 858 |
| 147068 | 65408 | 65419 | ATCCTGCACTGA | 1-10-1 MOE | 838 |
| 147071 | 65411 | 65422 | CTGATCCTGCAC | 1-10-1 MOE | 856 |
| 147069 | 65549 | 65560 | GATCCTGCACTG | 1-10-1 MOE | 860 |

TABLE 16-continued

Short Antisense Compounds targeted to SEQ ID NO: 11

| ISIS NO. | 5' Target Site | 3' Target Site | Sequence (5'-3') | Gapmer Motif | SEQ ID NO |
|---|---|---|---|---|---|
| 147068 | 65554 | 65565 | ATCCTGCACTGA | 1-10-1 MOE | 838 |
| 147071 | 65557 | 65568 | CTGATCCTGCAC | 1-10-1 MOE | 856 |
| 147029 | 67741 | 67752 | CCCAGCCTTGTC | 1-10-1 MOE | 848 |
| 147030 | 67742 | 67753 | TCCCAGCCTTGT | 1-10-1 MOE | 874 |
| 147031 | 67743 | 67754 | TTCCCAGCCTTG | 1-10-1 MOE | 885 |
| 147028 | 67886 | 67897 | CCAGCCTTGTCG | 1-10-1 MOE | 846 |
| 147029 | 67887 | 67898 | CCCAGCCTTGTC | 1-10-1 MOE | 848 |
| 147030 | 67888 | 67899 | TCCCAGCCTTGT | 1-10-1 MOE | 874 |
| 147031 | 67889 | 67900 | TTCCCAGCCTTG | 1-10-1 MOE | 885 |
| 147043 | 68867 | 68878 | TGGTCAAAAGGG | 1-10-1 MOE | 881 |
| 147044 | 68868 | 68879 | GTGGTCAAAAGG | 1-10-1 MOE | 869 |
| 147045 | 68869 | 68880 | TGTGGTCAAAAG | 1-10-1 MOE | 883 |
| 147043 | 69013 | 69024 | TGGTCAAAAGGG | 1-10-1 MOE | 881 |
| 147044 | 69014 | 69025 | GTGGTCAAAAGG | 1-10-1 MOE | 869 |
| 147045 | 69015 | 69026 | TGTGGTCAAAAG | 1-10-1 MOE | 883 |
| 147046 | 69016 | 69027 | CTGTGGTCAAAA | 1-10-1 MOE | 858 |
| 147071 | 69519 | 69530 | CTGATCCTGCAC | 1-10-1 MOE | 856 |
| 147072 | 69520 | 69531 | ACTGATCCTGCA | 1-10-1 MOE | 832 |
| 147073 | 69521 | 69532 | CACTGATCCTGC | 1-10-1 MOE | 842 |
| 147071 | 69665 | 69676 | CTGATCCTGCAC | 1-10-1 MOE | 856 |
| 147072 | 69666 | 69677 | ACTGATCCTGCA | 1-10-1 MOE | 832 |
| 147073 | 69667 | 69678 | CACTGATCCTGC | 1-10-1 MOE | 842 |
| 147074 | 69668 | 69679 | CCACTGATCCTG | 1-10-1 MOE | 845 |
| 147066 | 69869 | 69880 | CCTGCACTGACG | 1-10-1 MOE | 851 |
| 147066 | 70015 | 70026 | CCTGCACTGACG | 1-10-1 MOE | 851 |
| 147023 | 70465 | 70476 | CTTGTCGATCTC | 1-10-1 MOE | 859 |
| 147023 | 70611 | 70622 | CTTGTCGATCTC | 1-10-1 MOE | 859 |
| 147062 | 70615 | 70626 | CACTGACGAGTC | 1-10-1 MOE | 841 |
| 147063 | 70616 | 70627 | GCACTGACGAGT | 1-10-1 MOE | 862 |
| 147064 | 70617 | 70628 | TGCACTGACGAG | 1-10-1 MOE | 880 |
| 147065 | 70618 | 70629 | CTGCACTGACGA | 1-10-1 MOE | 857 |
| 147066 | 70619 | 70630 | CCTGCACTGACG | 1-10-1 MOE | 851 |
| 147063 | 70762 | 70773 | GCACTGACGAGT | 1-10-1 MOE | 862 |
| 147064 | 70763 | 70774 | TGCACTGACGAG | 1-10-1 MOE | 880 |
| 147065 | 70764 | 70775 | CTGCACTGACGA | 1-10-1 MOE | 857 |
| 147066 | 70765 | 70776 | CCTGCACTGACG | 1-10-1 MOE | 851 |
| 147072 | 70998 | 71009 | ACTGATCCTGCA | 1-10-1 MOE | 832 |
| 147073 | 70999 | 71010 | CACTGATCCTGC | 1-10-1 MOE | 842 |
| 147072 | 71144 | 71155 | ACTGATCCTGCA | 1-10-1 MOE | 832 |
| 147073 | 71145 | 71156 | CACTGATCCTGC | 1-10-1 MOE | 842 |
| 147074 | 71146 | 71157 | CCACTGATCCTG | 1-10-1 MOE | 845 |
| 147037 | 71351 | 71362 | GCCCAGTTCCCA | 1-10-1 MOE | 863 |
| 147038 | 71352 | 71363 | CGCCCAGTTCCC | 1-10-1 MOE | 855 |
| 147039 | 71353 | 71364 | CCGCCCAGTTCC | 1-10-1 MOE | 850 |
| 147037 | 71497 | 71508 | GCCCAGTTCCCA | 1-10-1 MOE | 863 |
| 147038 | 71498 | 71509 | CGCCCAGTTCCC | 1-10-1 MOE | 855 |
| 147039 | 71499 | 71510 | CCGCCCAGTTCC | 1-10-1 MOE | 850 |
| 147061 | 71641 | 71652 | TGCAATTTAATC | 1-10-1 MOE | 879 |
| 147061 | 71787 | 71798 | TGCAATTTAATC | 1-10-1 MOE | 879 |

TABLE 17

Short antisense compounds targeted to SEQ ID NO: 11 and having 1 or 2 mismatches

| ISIS NO. | 5' Target Site | 3' Target Site | Sequence (5'-3') | Gapmer Motif | SEQ ID NO |
|---|---|---|---|---|---|
| 147022 | 177 | 188 | TTGTCGATCTCC | 1-10-1 MOE | 886 |
| 147023 | 178 | 189 | CTTGTCGATCTC | 1-10-1 MOE | 859 |
| 147020 | 196 | 207 | GTCGATCTCCTC | 1-10-1 MOE | 868 |
| 147022 | 198 | 209 | TTGTCGATCTCC | 1-10-1 MOE | 886 |
| 147024 | 200 | 211 | CCTTGTCGATCT | 1-10-1 MOE | 853 |
| 147026 | 202 | 213 | AGCCTTGTCGAT | 1-10-1 MOE | 835 |
| 147028 | 204 | 215 | CCAGCCTTGTCG | 1-10-1 MOE | 846 |
| 147029 | 205 | 216 | CCCAGCCTTGTC | 1-10-1 MOE | 848 |
| 147030 | 206 | 217 | TCCCAGCCTTGT | 1-10-1 MOE | 874 |
| 147036 | 212 | 223 | CCCAGTTCCCAG | 1-10-1 MOE | 849 |
| 147073 | 311 | 322 | CACTGATCCTGC | 1-10-1 MOE | 842 |
| 147046 | 327 | 338 | CTGTGGTCAAAA | 1-10-1 MOE | 858 |
| 147047 | 328 | 339 | ACTGTGGTCAAA | 1-10-1 MOE | 833 |
| 147048 | 329 | 340 | GACTGTGGTCAA | 1-10-1 MOE | 888 |
| 147049 | 330 | 341 | CGACTGTGGTCA | 1-10-1 MOE | 854 |
| 147050 | 331 | 342 | CCGACTGTGGTC | 1-10-1 MOE | 889 |
| 147051 | 332 | 343 | TCCGACTGTGGT | 1-10-1 MOE | 875 |

TABLE 17-continued

Short antisense compounds targeted to SEQ ID NO: 11 and having 1 or 2 mismatches

| ISIS NO. | 5' Target Site | 3' Target Site | Sequence (5'-3') | Gapmer Motif | SEQ ID NO |
|---|---|---|---|---|---|
| 147052 | 333 | 344 | ATCCGACTGTGG | 1-10-1 MOE | 837 |
| 147053 | 334 | 345 | AATCCGACTGTG | 1-10-1 MOE | 829 |
| 147054 | 335 | 346 | TAATCCGACTGT | 1-10-1 MOE | 871 |
| 147055 | 336 | 347 | TTAATCCGACTG | 1-10-1 MOE | 884 |
| 147056 | 337 | 348 | TTTAATCCGACT | 1-10-1 MOE | 887 |
| 147057 | 338 | 349 | ATTTAATCCGAC | 1-10-1 MOE | 839 |
| 147058 | 339 | 350 | AATTTAATCCGA | 1-10-1 MOE | 830 |
| 147060 | 341 | 352 | GCAATTTAATCC | 1-10-1 MOE | 861 |
| 147061 | 342 | 353 | TGCAATTTAATC | 1-10-1 MOE | 879 |
| 147062 | 1024 | 1035 | CACTGACGAGTC | 1-10-1 MOE | 841 |
| 147063 | 1025 | 1036 | GCACTGACGAGT | 1-10-1 MOE | 862 |
| 147068 | 1030 | 1041 | ATCCTGCACTGA | 1-10-1 MOE | 838 |
| 147071 | 1033 | 1044 | CTGATCCTGCAC | 1-10-1 MOE | 856 |
| 147073 | 1035 | 1046 | CACTGATCCTGC | 1-10-1 MOE | 842 |
| 147074 | 1036 | 1047 | CCACTGATCCTG | 1-10-1 MOE | 845 |
| 147067 | 1091 | 1102 | TCCTGCACTGAC | 1-10-1 MOE | 876 |
| 147024 | 1891 | 1902 | CCTTGTCGATCT | 1-10-1 MOE | 853 |
| 147026 | 1893 | 1904 | AGCCTTGTCGAT | 1-10-1 MOE | 835 |
| 147029 | 1896 | 1907 | CCCAGCCTTGTC | 1-10-1 MOE | 848 |
| 147036 | 1903 | 1914 | CCCAGTTCCCAG | 1-10-1 MOE | 849 |
| 147039 | 1906 | 1917 | CCGCCCAGTTCC | 1-10-1 MOE | 850 |
| 147019 | 1994 | 2005 | TCGATCTCCTCG | 1-10-1 MOE | 877 |
| 401385 | 2815 | 2828 | CCCAGTGGGTTTGA | 2-10-2 MOE | 890 |
| 147033 | 5265 | 5276 | AGTTCCCAGCCT | 1-10-1 MOE | 836 |
| 147033 | 5373 | 5384 | AGTTCCCAGCCT | 1-10-1 MOE | 836 |
| 147060 | 7168 | 7179 | GCAATTTAATCC | 1-10-1 MOE | 861 |
| 147053 | 10527 | 10538 | AATCCGACTGTG | 1-10-1 MOE | 829 |
| 147053 | 10635 | 10646 | AATCCGACTGTG | 1-10-1 MOE | 829 |
| 147070 | 11604 | 11615 | TGATCCTGCACT | 1-10-1 MOE | 878 |
| 147071 | 11612 | 11623 | CTGATCCTGCAC | 1-10-1 MOE | 856 |
| 147072 | 12294 | 12305 | ACTGATCCTGCA | 1-10-1 MOE | 832 |
| 147072 | 12299 | 12310 | ACTGATCCTGCA | 1-10-1 MOE | 832 |
| 147052 | 12938 | 12949 | ATCCGACTGTGG | 1-10-1 MOE | 837 |
| 147052 | 13119 | 13130 | ATCCGACTGTGG | 1-10-1 MOE | 837 |
| 147047 | 13158 | 13169 | ACTGTGGTCAAA | 1-10-1 MOE | 833 |
| 147048 | 13159 | 13170 | GACTGTGGTCAA | 1-10-1 MOE | 888 |
| 147049 | 13160 | 13171 | CGACTGTGGTCA | 1-10-1 MOE | 854 |
| 147048 | 13340 | 13351 | GACTGTGGTCAA | 1-10-1 MOE | 888 |
| 147049 | 13341 | 13352 | CGACTGTGGTCA | 1-10-1 MOE | 854 |
| 147051 | 13343 | 13354 | TCCGACTGTGGT | 1-10-1 MOE | 875 |
| 147061 | 13497 | 13508 | TGCAATTTAATC | 1-10-1 MOE | 879 |
| 147069 | 15562 | 15573 | GATCCTGCACTG | 1-10-1 MOE | 860 |
| 147068 | 15743 | 15754 | ATCCTGCACTGA | 1-10-1 MOE | 838 |
| 147049 | 17181 | 17192 | CGACTGTGGTCA | 1-10-1 MOE | 854 |
| 147049 | 17349 | 17360 | CGACTGTGGTCA | 1-10-1 MOE | 854 |
| 147047 | 22438 | 22449 | ACTGTGGTCAAA | 1-10-1 MOE | 833 |
| 147047 | 24322 | 24333 | ACTGTGGTCAAA | 1-10-1 MOE | 833 |
| 147045 | 24488 | 24499 | TGTGGTCAAAAG | 1-10-1 MOE | 883 |
| 147039 | 25064 | 25075 | CCGCCCAGTTCC | 1-10-1 MOE | 850 |
| 147057 | 25508 | 25519 | ATTTAATCCGAC | 1-10-1 MOE | 839 |
| 147057 | 25676 | 25687 | ATTTAATCCGAC | 1-10-1 MOE | 839 |
| 147061 | 25680 | 25691 | TGCAATTTAATC | 1-10-1 MOE | 879 |
| 147069 | 28731 | 28742 | GATCCTGCACTG | 1-10-1 MOE | 860 |
| 147052 | 30132 | 30143 | ATCCGACTGTGG | 1-10-1 MOE | 837 |
| 147052 | 30277 | 30288 | ATCCGACTGTGG | 1-10-1 MOE | 837 |
| 147036 | 32085 | 32096 | CCCAGTTCCCAG | 1-10-1 MOE | 849 |
| 147072 | 32520 | 32531 | ACTGATCCTGCA | 1-10-1 MOE | 832 |
| 147071 | 33058 | 33069 | CTGATCCTGCAC | 1-10-1 MOE | 856 |
| 147050 | 33125 | 33136 | CCGACTGTGGTC | 1-10-1 MOE | 889 |
| 147069 | 33204 | 33215 | GATCCTGCACTG | 1-10-1 MOE | 860 |
| 147050 | 33273 | 33284 | CCGACTGTGGTC | 1-10-1 MOE | 889 |
| 147047 | 33319 | 33330 | ACTGTGGTCAAA | 1-10-1 MOE | 833 |
| 147050 | 33322 | 33333 | CCGACTGTGGTC | 1-10-1 MOE | 889 |
| 147052 | 33324 | 33335 | ATCCGACTGTGG | 1-10-1 MOE | 837 |
| 147049 | 33469 | 33480 | CGACTGTGGTCA | 1-10-1 MOE | 854 |
| 147050 | 33470 | 33481 | CCGACTGTGGTC | 1-10-1 MOE | 889 |
| 147052 | 33472 | 33483 | ATCCGACTGTGG | 1-10-1 MOE | 837 |
| 147047 | 33641 | 33652 | ACTGTGGTCAAA | 1-10-1 MOE | 833 |
| 147047 | 33789 | 33800 | ACTGTGGTCAAA | 1-10-1 MOE | 833 |
| 147059 | 35585 | 35596 | CAATTTAATCCG | 1-10-1 MOE | 840 |
| 147021 | 36241 | 36252 | TGTCGATCTCCT | 1-10-1 MOE | 882 |
| 147073 | 37633 | 37644 | CACTGATCCTGC | 1-10-1 MOE | 842 |

TABLE 17-continued

Short antisense compounds targeted to SEQ ID
NO: 11 and having 1 or 2 mismatches

| ISIS NO. | 5' Target Site | 3' Target Site | Sequence (5'-3') | Gapmer Motif | SEQ ID NO |
|---|---|---|---|---|---|
| 147033 | 42529 | 42540 | AGTTCCCAGCCT | 1-10-1 MOE | 836 |
| 147050 | 45401 | 45412 | CCGACTGTGGTC | 1-10-1 MOE | 889 |
| 147050 | 45549 | 45560 | CCGACTGTGGTC | 1-10-1 MOE | 889 |
| 147074 | 46125 | 46136 | CCACTGATCCTG | 1-10-1 MOE | 845 |
| 147057 | 46313 | 46324 | ATTTAATCCGAC | 1-10-1 MOE | 839 |
| 147058 | 46462 | 46473 | AATTTAATCCGA | 1-10-1 MOE | 830 |
| 147058 | 47413 | 47424 | AATTTAATCCGA | 1-10-1 MOE | 830 |
| 147058 | 47561 | 47572 | AATTTAATCCGA | 1-10-1 MOE | 830 |
| 147073 | 48221 | 48232 | CACTGATCCTGC | 1-10-1 MOE | 842 |
| 147073 | 48369 | 48380 | CACTGATCCTGC | 1-10-1 MOE | 842 |
| 147028 | 48567 | 48578 | CCAGCCTTGTCG | 1-10-1 MOE | 846 |
| 147068 | 49199 | 49210 | ATCCTGCACTGA | 1-10-1 MOE | 838 |
| 147036 | 50273 | 50284 | CCCAGTTCCCAG | 1-10-1 MOE | 849 |
| 147040 | 53929 | 53940 | GCCGCCCAGTTC | 1-10-1 MOE | 864 |
| 147047 | 54769 | 54780 | ACTGTGGTCAAA | 1-10-1 MOE | 833 |
| 147048 | 54770 | 54781 | GACTGTGGTCAA | 1-10-1 MOE | 888 |
| 147047 | 54915 | 54926 | ACTGTGGTCAAA | 1-10-1 MOE | 833 |
| 147048 | 54916 | 54927 | GACTGTGGTCAA | 1-10-1 MOE | 888 |
| 147019 | 55828 | 55839 | TCGATCTCCTCG | 1-10-1 MOE | 877 |
| 147047 | 56268 | 56279 | ACTGTGGTCAAA | 1-10-1 MOE | 833 |
| 147048 | 56269 | 56280 | GACTGTGGTCAA | 1-10-1 MOE | 888 |
| 147049 | 56270 | 56281 | CGACTGTGGTCA | 1-10-1 MOE | 854 |
| 147050 | 56271 | 56282 | CCGACTGTGGTC | 1-10-1 MOE | 889 |
| 147051 | 56272 | 56283 | TCCGACTGTGGT | 1-10-1 MOE | 875 |
| 147052 | 56273 | 56284 | ATCCGACTGTGG | 1-10-1 MOE | 837 |
| 147053 | 56274 | 56285 | AATCCGACTGTG | 1-10-1 MOE | 829 |
| 147056 | 56277 | 56288 | TTTAATCCGACT | 1-10-1 MOE | 887 |
| 147057 | 56278 | 56289 | ATTTAATCCGAC | 1-10-1 MOE | 839 |
| 147047 | 56414 | 56425 | ACTGTGGTCAAA | 1-10-1 MOE | 833 |
| 147048 | 56415 | 56426 | GACTGTGGTCAA | 1-10-1 MOE | 888 |
| 147049 | 56416 | 56427 | CGACTGTGGTCA | 1-10-1 MOE | 854 |
| 147050 | 56417 | 56428 | CCGACTGTGGTC | 1-10-1 MOE | 889 |
| 147052 | 56419 | 56430 | ATCCGACTGTGG | 1-10-1 MOE | 837 |
| 147057 | 56424 | 56435 | ATTTAATCCGAC | 1-10-1 MOE | 839 |
| 147058 | 56425 | 56436 | AATTTAATCCGA | 1-10-1 MOE | 830 |
| 147059 | 56426 | 56437 | CAATTTAATCCG | 1-10-1 MOE | 840 |
| 147060 | 56427 | 56438 | GCAATTTAATCC | 1-10-1 MOE | 861 |
| 147046 | 57119 | 57130 | CTGTGGTCAAAA | 1-10-1 MOE | 858 |
| 147071 | 58174 | 58185 | CTGATCCTGCAC | 1-10-1 MOE | 856 |
| 147071 | 61130 | 61141 | CTGATCCTGCAC | 1-10-1 MOE | 856 |
| 147034 | 61276 | 61287 | CAGTTCCCAGCC | 1-10-1 MOE | 844 |
| 147071 | 61309 | 61320 | CTGATCCTGCAC | 1-10-1 MOE | 856 |
| 147039 | 61427 | 61438 | CCGCCCAGTTCC | 1-10-1 MOE | 850 |
| 147071 | 61455 | 61466 | CTGATCCTGCAC | 1-10-1 MOE | 856 |
| 147073 | 62003 | 62014 | CACTGATCCTGC | 1-10-1 MOE | 842 |
| 147062 | 63061 | 63072 | CACTGACGAGTC | 1-10-1 MOE | 841 |
| 147068 | 63213 | 63224 | ATCCTGCACTGA | 1-10-1 MOE | 838 |
| 147069 | 63292 | 63303 | GATCCTGCACTG | 1-10-1 MOE | 860 |
| 147057 | 64054 | 64065 | ATTTAATCCGAC | 1-10-1 MOE | 839 |
| 147057 | 64200 | 64211 | ATTTAATCCGAC | 1-10-1 MOE | 839 |
| 147070 | 64427 | 64438 | TGATCCTGCACT | 1-10-1 MOE | 878 |
| 147070 | 64573 | 64584 | TGATCCTGCACT | 1-10-1 MOE | 878 |
| 147036 | 64684 | 64695 | CCCAGTTCCCAG | 1-10-1 MOE | 849 |
| 147046 | 65018 | 65029 | CTGTGGTCAAAA | 1-10-1 MOE | 858 |
| 147071 | 65557 | 65568 | CTGATCCTGCAC | 1-10-1 MOE | 856 |
| 147069 | 65695 | 65706 | GATCCTGCACTG | 1-10-1 MOE | 860 |
| 147047 | 66163 | 66174 | ACTGTGGTCAAA | 1-10-1 MOE | 833 |
| 147047 | 66309 | 66320 | ACTGTGGTCAAA | 1-10-1 MOE | 833 |
| 147028 | 67740 | 67751 | CCAGCCTTGTCG | 1-10-1 MOE | 846 |
| 147046 | 68870 | 68881 | CTGTGGTCAAAA | 1-10-1 MOE | 858 |
| 147047 | 68871 | 68882 | ACTGTGGTCAAA | 1-10-1 MOE | 833 |
| 147048 | 68872 | 68883 | GACTGTGGTCAA | 1-10-1 MOE | 888 |
| 147049 | 68873 | 68884 | CGACTGTGGTCA | 1-10-1 MOE | 854 |
| 147047 | 69017 | 69028 | ACTGTGGTCAAA | 1-10-1 MOE | 833 |
| 147048 | 69018 | 69029 | GACTGTGGTCAA | 1-10-1 MOE | 888 |
| 147049 | 69019 | 69030 | CGACTGTGGTCA | 1-10-1 MOE | 854 |
| 147071 | 69519 | 69530 | CTGATCCTGCAC | 1-10-1 MOE | 856 |
| 147073 | 69521 | 69532 | CACTGATCCTGC | 1-10-1 MOE | 842 |
| 147071 | 69665 | 69676 | CTGATCCTGCAC | 1-10-1 MOE | 856 |
| 147072 | 69666 | 69677 | ACTGATCCTGCA | 1-10-1 MOE | 832 |
| 147024 | 70466 | 70477 | CCTTGTCGATCT | 1-10-1 MOE | 853 |
| 147024 | 70612 | 70623 | CCTTGTCGATCT | 1-10-1 MOE | 853 |

TABLE 17-continued

Short antisense compounds targeted to SEQ ID NO: 11 and having 1 or 2 mismatches

| ISIS NO. | 5' Target Site | 3' Target Site | Sequence (5'-3') | Gapmer Motif | SEQ ID NO |
|---|---|---|---|---|---|
| 147062 | 70761 | 70772 | CACTGACGAGTC | 1-10-1 MOE | 841 |
| 147072 | 70998 | 71009 | ACTGATCCTGCA | 1-10-1 MOE | 832 |
| 147073 | 70999 | 71010 | CACTGATCCTGC | 1-10-1 MOE | 842 |
| 147072 | 71144 | 71155 | ACTGATCCTGCA | 1-10-1 MOE | 832 |
| 147073 | 71145 | 71156 | CACTGATCCTGC | 1-10-1 MOE | 842 |
| 147048 | 71366 | 71377 | GACTGTGGTCAA | 1-10-1 MOE | 888 |
| 147048 | 71512 | 71523 | GACTGTGGTCAA | 1-10-1 MOE | 888 |

TABLE 18

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 398163 | 20 | 31 | ATGTCAACCGGC | 1-10-1 MOE | 908 |
| 384545 | 23 | 34 | CAAGTAGGATGT | 1-10-1 MOE | 951 |
| 147705 | 159 | 170 | CGGTTTTGTTC | 1-10-1 MOE | 1002 |
| 147703 | 245 | 256 | TGGCTTCATGTC | 1-10-1 MOE | 971 |
| 398090 | 283 | 296 | TTGTTCTTAGGAAG | 2-10-2 MOE | 972 |
| 147704 | 285 | 296 | TTGTTCTTAGGA | 1-10-1 MOE | 1012 |
| 147705 | 291 | 302 | CGGTTTTGTTC | 1-10-1 MOE | 1002 |
| 147709 | 311 | 322 | CCATTTTATCA | 1-10-1 MOE | 978 |
| 147733 | 349 | 360 | TTCTTGATGTCC | 1-10-1 MOE | 891 |
| 147707 | 360 | 371 | TAGTCATTATCT | 1-10-1 MOE | 977 |
| 147708 | 366 | 377 | TTGATATAGTCA | 1-10-1 MOE | 997 |
| 390030 | 381 | 392 | TTTATAAAACTG | 1-10-1 MOE | 1074 |
| 147709 | 386 | 397 | CCATTTTATCA | 1-10-1 MOE | 978 |
| 147081 | 393 | 404 | GCTCCTTCCACT | 1-10-1 MOE | 1006 |
| 398091 | 393 | 406 | GGGCTTCTTCCATT | 2-10-2 MOE | 979 |
| 398166 | 395 | 406 | GGGCTTCTTCCA | 1-10-1 MOE | 1070 |
| 147709 | 418 | 429 | CCATTTTATCA | 1-10-1 MOE | 978 |
| 147711 | 425 | 436 | AAGGGCCCTGGG | 1-10-1 MOE | 1040 |
| 147712 | 461 | 472 | ACACCATCTCCC | 1-10-1 MOE | 1005 |
| 147713 | 466 | 477 | CTCCCACACCAT | 1-10-1 MOE | 985 |
| 147714 | 471 | 482 | TTCTGCTCCCAC | 1-10-1 MOE | 986 |
| 147715 | 496 | 507 | GTTGAGCATGAC | 1-10-1 MOE | 1077 |
| 147716 | 521 | 532 | TTAACGAGCCTT | 1-10-1 MOE | 949 |
| 147717 | 574 | 585 | ATCTTCAGAGAT | 1-10-1 MOE | 996 |
| 147717 | 607 | 618 | ATCTTCAGAGAT | 1-10-1 MOE | 996 |
| 147708 | 612 | 623 | TTGATATAGTCA | 1-10-1 MOE | 997 |
| 147718 | 621 | 632 | TAATATGACTTG | 1-10-1 MOE | 998 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147746 | 625 | 636 | TAAAAACAACAA | 1-10-1 MOE | 1073 |
| 398167 | 704 | 715 | CAGGCCATGTGG | 1-10-1 MOE | 1059 |
| 398092 | 705 | 718 | AGTCAGGCCATGTG | 2-10-2 MOE | 1060 |
| 147723 | 715 | 726 | GACTCCAAAGTC | 1-10-1 MOE | 892 |
| 398093 | 758 | 771 | TCGGACTTTGAAAA | 2-10-2 MOE | 1009 |
| 398168 | 760 | 771 | TCGGACTTTGAA | 1-10-1 MOE | 1008 |
| 147738 | 780 | 791 | TGGGTGGCCGGG | 1-10-1 MOE | 1069 |
| 398094 | 848 | 861 | ATCAGCCAGACAGA | 2-10-2 MOE | 1010 |
| 398169 | 849 | 860 | TCAGCCAGACAG | 1-10-1 MOE | 909 |
| 398164 | 873 | 884 | TTGTCGATCTGC | 1-10-1 MOE | 1014 |
| 147735 | 973 | 984 | GGAGAAGCGCAG | 1-10-1 MOE | 1016 |
| 147737 | 984 | 995 | ACAGCCAGGTAG | 1-10-1 MOE | 1067 |
| 368369 | 1025 | 1040 | TCCTGCACTGACGAGT | 3-10-3 MOE | 893 |
| 368372 | 1031 | 1046 | CACTGATCCTGCACTG | 3-10-3 MOE | 894 |
| 368353 | 1033 | 1046 | CACTGATCCTGCAC | 2-10-2 MOE | 1007 |
| 368354 | 1035 | 1048 | TCCACTGATCCTGC | 2-10-2 MOE | 1024 |
| 368388 | 1035 | 1050 | CTTCCACTGATCCTTA | 3-10-3 MOE | 895 |
| 368355 | 1036 | 1049 | TTCCACTGATCCTG | 2-10-2 MOE | 1025 |
| 368356 | 1037 | 1050 | CTTCCACTGATCCT | 2-10-2 MOE | 1027 |
| 368376 | 1037 | 1052 | TCCTTCCACTGATCCT | 3-10-3 MOE | 1028 |
| 147076 | 1038 | 1049 | TTCCACTGATCC | 1-10-1 MOE | 1029 |
| 368357 | 1038 | 1051 | CCTTCCACTGATCC | 2-10-2 MOE | 1046 |
| 147077 | 1039 | 1050 | CTTCCACTGATC | 1-10-1 MOE | 1047 |
| 368358 | 1039 | 1052 | TCCTTCCACTGATC | 2-10-2 MOE | 1031 |
| 368378 | 1039 | 1054 | GCTCCTTCCACTGATC | 3-10-3 MOE | 1032 |
| 368359 | 1041 | 1054 | GCTCCTTCCACTGA | 2-10-2 MOE | 1033 |
| 147080 | 1042 | 1053 | CTCCTTCCACTG | 1-10-1 MOE | 1021 |
| 147081 | 1043 | 1054 | GCTCCTTCCACT | 1-10-1 MOE | 1006 |
| 368360 | 1043 | 1056 | AAGCTCCTTCCACT | 2-10-2 MOE | 1035 |
| 368380 | 1043 | 1058 | GAAAGCTCCTTCCACT | 3-10-3 MOE | 896 |
| 147082 | 1044 | 1055 | AGCTCCTTCCAC | 1-10-1 MOE | 1036 |
| 368381 | 1045 | 1060 | GGGAAAGCTCCTTCCA | 3-10-3 MOE | 1037 |
| 147739 | 1107 | 1118 | CGTTTGGGTGGC | 1-10-1 MOE | 1023 |
| 147741 | 1165 | 1176 | CACCCACTGGTG | 1-10-1 MOE | 1055 |
| 398097 | 1194 | 1207 | GGCAGTCTTTATCC | 2-10-2 MOE | 897 |
| 147742 | 1273 | 1284 | AACTTCAGTGTC | 1-10-1 MOE | 1041 |
| 147743 | 1388 | 1399 | AGGGCTTCCAGT | 1-10-1 MOE | 1042 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147744 | 1392 | 1403 | AGGAAGGGCTTC | 1-10-1 MOE | 1043 |
| 147745 | 1398 | 1409 | TTGACCAGGAAG | 1-10-1 MOE | 1058 |
| 398157 | 1455 | 1468 | GGAAACATACCCTG | 2-10-2 MOE | 1045 |
| 398167 | 1475 | 1486 | CAGGCCATGTGG | 1-10-1 MOE | 1059 |
| 398092 | 1476 | 1489 | AGTCAGGCCATGTG | 2-10-2 MOE | 1060 |
| 368357 | 1596 | 1609 | CCTTCCACTGATCC | 2-10-2 MOE | 1046 |
| 398160 | 1691 | 1704 | GAATAGGTTAAGGC | 2-10-2 MOE | 1048 |
| 398163 | 1711 | 1722 | ATGTCAACCGGC | 1-10-1 MOE | 908 |
| 147746 | 1750 | 1761 | TAAAAACAACAA | 1-10-1 MOE | 1073 |
| 389949 | 1777 | 1788 | GCGCGAGCCCGA | 1-10-1 MOE | 1061 |
| 398161 | 1790 | 1803 | AACAATGTGTTGTA | 2-10-2 MOE | 1049 |
| 147746 | 1799 | 1810 | TAAAAACAACAA | 1-10-1 MOE | 1073 |
| 398163 | 1819 | 1830 | ATGTCAACCGGC | 1-10-1 MOE | 908 |
| 389950 | 1848 | 1859 | CCCTGAAGGTTC | 1-10-1 MOE | 1063 |
| 398164 | 1889 | 1900 | TTGTCGATCTGC | 1-10-1 MOE | 1014 |
| 147702 | 1917 | 1928 | CTGGTAAATAGC | 1-10-1 MOE | 898 |
| 147088 | 1971 | 1982 | CCCTCTACACCA | 1-10-1 MOE | 1050 |
| 398102 | 2003 | 2016 | CTACCTGAGGATTT | 2-10-2 MOE | 899 |
| 398103 | 2010 | 2023 | CCCAGTACTACCTG | 2-10-2 MOE | 900 |
| 147737 | 2386 | 2397 | ACAGCCAGGTAG | 1-10-1 MOE | 1067 |
| 398095 | 2407 | 2420 | CATCAGCAAGAGGC | 2-10-2 MOE | 1011 |
| 398106 | 2441 | 2454 | TGGAAAACTGCACC | 2-10-2 MOE | 1068 |
| 147745 | 2497 | 2508 | TTGACCAGGAAG | 1-10-1 MOE | 1058 |
| 147712 | 2499 | 2510 | ACACCATCTCCC | 1-10-1 MOE | 1005 |
| 147712 | 2607 | 2618 | ACACCATCTCCC | 1-10-1 MOE | 1005 |
| 147745 | 2689 | 2700 | TTGACCAGGAAG | 1-10-1 MOE | 1058 |
| 398167 | 2706 | 2717 | CAGGCCATGTGG | 1-10-1 MOE | 1059 |
| 398092 | 2707 | 2720 | AGTCAGGCCATGTG | 2-10-2 MOE | 1060 |
| 398166 | 2966 | 2977 | GGGCTTCTTCCA | 1-10-1 MOE | 1070 |
| 147091 | 2992 | 3003 | GTTCCCTCTACA | 1-10-1 MOE | 1004 |
| 147092 | 2993 | 3004 | TGTTCCCTCTAC | 1-10-1 MOE | 901 |
| 389949 | 3008 | 3019 | GCGCGAGCCCGA | 1-10-1 MOE | 1061 |
| 147087 | 3149 | 3160 | CCTCTACACCAG | 1-10-1 MOE | 982 |
| 147088 | 3150 | 3161 | CCCTCTACACCA | 1-10-1 MOE | 1050 |
| 398113 | 3160 | 3173 | AGGAGGTTAAACCA | 2-10-2 MOE | 905 |
| 147087 | 3257 | 3268 | CCTCTACACCAG | 1-10-1 MOE | 982 |
| 147088 | 3258 | 3269 | CCCTCTACACCA | 1-10-1 MOE | 1050 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147737 | 3591 | 3602 | ACAGCCAGGTAG | 1-10-1 MOE | 1067 |
| 147737 | 3617 | 3628 | ACAGCCAGGTAG | 1-10-1 MOE | 1067 |
| 147079 | 3637 | 3648 | TCCTTCCACTGA | 1-10-1 MOE | 1001 |
| 147080 | 3638 | 3649 | CTCCTTCCACTG | 1-10-1 MOE | 1021 |
| 398095 | 3638 | 3651 | CATCAGCAAGAGGC | 2-10-2 MOE | 1011 |
| 398106 | 3672 | 3685 | TGGAAAACTGCACC | 2-10-2 MOE | 1068 |
| 398107 | 3678 | 3691 | TATTCCTGGAAAAC | 2-10-2 MOE | 902 |
| 147691 | 3806 | 3817 | GAGGTGGGAAAA | 1-10-1 MOE | 966 |
| 147683 | 3848 | 3859 | GCTTACGATTGT | 1-10-1 MOE | 922 |
| 147738 | 3853 | 3864 | TGGGTGGCCGGG | 1-10-1 MOE | 1069 |
| 398167 | 3926 | 3937 | CAGGCCATGTGG | 1-10-1 MOE | 1059 |
| 398109 | 3945 | 3958 | CAAGAAGTGTGGTT | 2-10-2 MOE | 903 |
| 398167 | 4034 | 4045 | CAGGCCATGTGG | 1-10-1 MOE | 1059 |
| 398110 | 4083 | 4096 | GTTCCCTTTGCAGG | 2-10-2 MOE | 952 |
| 398111 | 4168 | 4181 | GTGAAAATGCTGGC | 2-10-2 MOE | 904 |
| 147706 | 4238 | 4249 | GCTGACATCTCG | 1-10-1 MOE | 1071 |
| 398112 | 4282 | 4295 | CAGCCTGGCACCTA | 2-10-2 MOE | 1072 |
| 147746 | 4315 | 4326 | TAAAAACAACAA | 1-10-1 MOE | 1073 |
| 398113 | 4391 | 4404 | AGGAGGTTAAACCA | 2-10-2 MOE | 905 |
| 398115 | 4484 | 4497 | AGTAAATATTGGCT | 2-10-2 MOE | 1076 |
| 390030 | 4491 | 4502 | TTTATAAAACTG | 1-10-1 MOE | 1074 |
| 390030 | 4537 | 4548 | TTTATAAAACTG | 1-10-1 MOE | 1074 |
| 147703 | 5034 | 5045 | TGGCTTCATGTC | 1-10-1 MOE | 971 |
| 147684 | 5035 | 5046 | ACCCAGTCAGGG | 1-10-1 MOE | 964 |
| 398125 | 5075 | 5088 | CAGTAAGGAATTTT | 2-10-2 MOE | 913 |
| 147696 | 5083 | 5094 | TGGATGATTGGC | 1-10-1 MOE | 906 |
| 147684 | 5143 | 5154 | ACCCAGTCAGGG | 1-10-1 MOE | 964 |
| 147712 | 5366 | 5377 | ACACCATCTCCC | 1-10-1 MOE | 1005 |
| 147714 | 5416 | 5427 | TTCTGCTCCCAC | 1-10-1 MOE | 986 |
| 398128 | 5443 | 5456 | CTAAATTTAGTTCA | 2-10-2 MOE | 911 |
| 147712 | 5474 | 5485 | ACACCATCTCCC | 1-10-1 MOE | 1005 |
| 147746 | 5498 | 5509 | TAAAAACAACAA | 1-10-1 MOE | 1073 |
| 147714 | 5524 | 5535 | TTCTGCTCCCAC | 1-10-1 MOE | 986 |
| 147736 | 5600 | 5611 | AGGTAGGAGAAG | 1-10-1 MOE | 963 |
| 147085 | 5762 | 5773 | TCTACACCAGGT | 1-10-1 MOE | 961 |
| 147679 | 5825 | 5836 | CAAAAGGATCCC | 1-10-1 MOE | 907 |
| 390030 | 6803 | 6814 | TTTATAAAACTG | 1-10-1 MOE | 1074 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 398142 | 6885 | 6898 | CCAGCACACTGGAA | 2-10-2 MOE | 923 |
| 398142 | 6994 | 7007 | CCAGCACACTGGAA | 2-10-2 MOE | 923 |
| 398166 | 7306 | 7317 | GGGCTTCTTCCA | 1-10-1 MOE | 1070 |
| 147684 | 7551 | 7562 | ACCCAGTCAGGG | 1-10-1 MOE | 964 |
| 147085 | 8308 | 8319 | TCTACACCAGGT | 1-10-1 MOE | 961 |
| 147085 | 8416 | 8427 | TCTACACCAGGT | 1-10-1 MOE | 961 |
| 398163 | 8473 | 8484 | ATGTCAACCGGC | 1-10-1 MOE | 908 |
| 147718 | 8523 | 8534 | TAATATGACTTG | 1-10-1 MOE | 998 |
| 147718 | 8631 | 8642 | TAATATGACTTG | 1-10-1 MOE | 998 |
| 147691 | 8806 | 8817 | GAGGTGGGAAAA | 1-10-1 MOE | 966 |
| 147728 | 8835 | 8846 | GCCAGACAGAAG | 1-10-1 MOE | 1013 |
| 147728 | 8943 | 8954 | GCCAGACAGAAG | 1-10-1 MOE | 1013 |
| 398169 | 8946 | 8957 | TCAGCCAGACAG | 1-10-1 MOE | 909 |
| 147742 | 9060 | 9071 | AACTTCAGTGTC | 1-10-1 MOE | 1041 |
| 404136 | 9162 | 9175 | TAAGTGTCCCTTTG | 2-10-2 MOE | 910 |
| 147746 | 9963 | 9974 | TAAAAACAACAA | 1-10-1 MOE | 1073 |
| 147746 | 9966 | 9977 | TAAAAACAACAA | 1-10-1 MOE | 1073 |
| 147746 | 9969 | 9980 | TAAAAACAACAA | 1-10-1 MOE | 1073 |
| 147746 | 9991 | 10002 | TAAAAACAACAA | 1-10-1 MOE | 1073 |
| 147746 | 10071 | 10082 | TAAAAACAACAA | 1-10-1 MOE | 1073 |
| 147746 | 10074 | 10085 | TAAAAACAACAA | 1-10-1 MOE | 1073 |
| 147746 | 10077 | 10088 | TAAAAACAACAA | 1-10-1 MOE | 1073 |
| 390030 | 10170 | 10181 | TTTATAAAACTG | 1-10-1 MOE | 1074 |
| 147084 | 10220 | 10231 | CTACACCAGGTC | 1-10-1 MOE | 993 |
| 390030 | 10278 | 10289 | TTTATAAAACTG | 1-10-1 MOE | 1074 |
| 147085 | 10329 | 10340 | TCTACACCAGGT | 1-10-1 MOE | 961 |
| 147711 | 10684 | 10695 | AAGGGCCCTGGG | 1-10-1 MOE | 1040 |
| 147711 | 10792 | 10803 | AAGGGCCCTGGG | 1-10-1 MOE | 1040 |
| 398128 | 11333 | 11346 | CTAAATTTAGTTCA | 2-10-2 MOE | 911 |
| 147707 | 11960 | 11971 | TAGTCATTATCT | 1-10-1 MOE | 977 |
| 147707 | 11965 | 11976 | TAGTCATTATCT | 1-10-1 MOE | 977 |
| 147090 | 12013 | 12024 | TTCCCTCTACAC | 1-10-1 MOE | 955 |
| 398096 | 12146 | 12159 | GGAGAAGCGCAGCT | 2-10-2 MOE | 1015 |
| 398166 | 12214 | 12225 | GGGCTTCTTCCA | 1-10-1 MOE | 1070 |
| 398135 | 12308 | 12321 | GACTACATTTTACA | 2-10-2 MOE | 912 |
| 147741 | 12389 | 12400 | CACCCACTGGTG | 1-10-1 MOE | 1055 |
| 398125 | 12431 | 12444 | CAGTAAGGAATTTT | 2-10-2 MOE | 913 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147714 | 12585 | 12596 | TTCTGCTCCCAC | 1-10-1 MOE | 986 |
| 147718 | 12594 | 12605 | TAATATGACTTG | 1-10-1 MOE | 998 |
| 398125 | 12612 | 12625 | CAGTAAGGAATTTT | 2-10-2 MOE | 913 |
| 147737 | 12803 | 12814 | ACAGCCAGGTAG | 1-10-1 MOE | 1067 |
| 147746 | 12876 | 12887 | TAAAAACAACAA | 1-10-1 MOE | 1073 |
| 147691 | 12900 | 12911 | GAGGTGGGAAAA | 1-10-1 MOE | 966 |
| 398137 | 13111 | 13124 | TGTGTCCCTCAGTC | 2-10-2 MOE | 914 |
| 398138 | 13254 | 13267 | AACATCAAGCTTGA | 2-10-2 MOE | 931 |
| 398137 | 13292 | 13305 | TGTGTCCCTCAGTC | 2-10-2 MOE | 914 |
| 398138 | 13435 | 13448 | AACATCAAGCTTGA | 2-10-2 MOE | 931 |
| 389764 | 14020 | 14031 | CTGCAACATGAT | 1-9-2 MOE | 1018 |
| 389948 | 14067 | 14078 | CCGTTGGACCCC | 1-10-1 MOE | 915 |
| 389948 | 14248 | 14259 | CCGTTGGACCCC | 1-10-1 MOE | 915 |
| 147738 | 14279 | 14290 | TGGGTGGCCGGG | 1-10-1 MOE | 1069 |
| 147698 | 14572 | 14583 | CCCGCCACCACC | 1-10-1 MOE | 928 |
| 147717 | 14750 | 14761 | ATCTTCAGAGAT | 1-10-1 MOE | 996 |
| 147717 | 14932 | 14943 | ATCTTCAGAGAT | 1-10-1 MOE | 996 |
| 398167 | 15374 | 15385 | CAGGCCATGTGG | 1-10-1 MOE | 1059 |
| 147736 | 16444 | 16455 | AGGTAGGAGAAG | 1-10-1 MOE | 963 |
| 147746 | 16510 | 16521 | TAAAAACAACAA | 1-10-1 MOE | 1073 |
| 147738 | 16590 | 16601 | TGGGTGGCCGGG | 1-10-1 MOE | 1069 |
| 147746 | 16676 | 16687 | TAAAAACAACAA | 1-10-1 MOE | 1073 |
| 398167 | 16797 | 16808 | CAGGCCATGTGG | 1-10-1 MOE | 1059 |
| 398144 | 16911 | 16924 | GACAGCTTCTATAA | 2-10-2 MOE | 916 |
| 389764 | 17096 | 17107 | CTGCAACATGAT | 1-9-2 MOE | 1018 |
| 147709 | 17238 | 17249 | CCATTTTTATCA | 1-10-1 MOE | 978 |
| 147709 | 17406 | 17417 | CCATTTTTATCA | 1-10-1 MOE | 978 |
| 147695 | 17466 | 17477 | TCATTCCCCACT | 1-10-1 MOE | 984 |
| 147746 | 17497 | 17508 | TAAAAACAACAA | 1-10-1 MOE | 1073 |
| 147088 | 17539 | 17550 | CCCTCTACACCA | 1-10-1 MOE | 1050 |
| 147711 | 17808 | 17819 | AAGGGCCCTGGG | 1-10-1 MOE | 1040 |
| 147711 | 17976 | 17987 | AAGGGCCCTGGG | 1-10-1 MOE | 1040 |
| 398139 | 18049 | 18062 | AGTGACTGACCACA | 2-10-2 MOE | 917 |
| 398139 | 18217 | 18230 | AGTGACTGACCACA | 2-10-2 MOE | 917 |
| 398140 | 18596 | 18609 | GTAGCATAGAGCCT | 2-10-2 MOE | 918 |
| 398140 | 18764 | 18777 | GTAGCATAGAGCCT | 2-10-2 MOE | 918 |
| 398167 | 18927 | 18938 | CAGGCCATGTGG | 1-10-1 MOE | 1059 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 398141 | 18947 | 18960 | CAGATCTTGTCAAG | 2-10-2 MOE | 919 |
| 398167 | 19095 | 19106 | CAGGCCATGTGG | 1-10-1 MOE | 1059 |
| 398141 | 19115 | 19128 | CAGATCTTGTCAAG | 2-10-2 MOE | 919 |
| 147746 | 19207 | 19218 | TAAAAACAACAA | 1-10-1 MOE | 1073 |
| 147711 | 19508 | 19519 | AAGGGCCCTGGG | 1-10-1 MOE | 1040 |
| 147729 | 19554 | 19565 | GTAAGAGGCAGG | 1-10-1 MOE | 920 |
| 147718 | 19617 | 19628 | TAATATGACTTG | 1-10-1 MOE | 998 |
| 390030 | 19618 | 19629 | TTTATAAAACTG | 1-10-1 MOE | 1074 |
| 147701 | 19671 | 19682 | CCATGGCGGGAC | 1-10-1 MOE | 921 |
| 147711 | 19676 | 19687 | AAGGGCCCTGGG | 1-10-1 MOE | 1040 |
| 147718 | 19785 | 19796 | TAATATGACTTG | 1-10-1 MOE | 998 |
| 147079 | 20515 | 20526 | TCCTTCCACTGA | 1-10-1 MOE | 1001 |
| 389764 | 20620 | 20631 | CTGCAACATGAT | 1-9-2 MOE | 1018 |
| 398142 | 20653 | 20666 | CCAGCACACTGGAA | 2-10-2 MOE | 923 |
| 147078 | 20682 | 20693 | CCTTCCACTGAT | 1-10-1 MOE | 1044 |
| 147079 | 20683 | 20694 | TCCTTCCACTGA | 1-10-1 MOE | 1001 |
| 147080 | 20704 | 20715 | CTCCTTCCACTG | 1-10-1 MOE | 1021 |
| 147081 | 20705 | 20716 | GCTCCTTCCACT | 1-10-1 MOE | 1006 |
| 389965 | 20788 | 20799 | CTGCAACATGAT | 1-10-1 MOE | 1018 |
| 147746 | 20870 | 20881 | TAAAAACAACAA | 1-10-1 MOE | 1073 |
| 147746 | 21038 | 21049 | TAAAAACAACAA | 1-10-1 MOE | 1073 |
| 147717 | 21080 | 21091 | ATCTTCAGAGAT | 1-10-1 MOE | 996 |
| 147076 | 21222 | 21233 | TTCCACTGATCC | 1-10-1 MOE | 1029 |
| 398094 | 21441 | 21454 | ATCAGCCAGACAGA | 2-10-2 MOE | 1010 |
| 147746 | 21633 | 21644 | TAAAAACAACAA | 1-10-1 MOE | 1073 |
| 147738 | 21884 | 21895 | TGGGTGGCCGGG | 1-10-1 MOE | 1069 |
| 147683 | 21939 | 21950 | GCTTACGATTGT | 1-10-1 MOE | 922 |
| 147743 | 22213 | 22224 | AGGGCTTCCAGT | 1-10-1 MOE | 1042 |
| 147736 | 22759 | 22770 | AGGTAGGAGAAG | 1-10-1 MOE | 963 |
| 147736 | 22927 | 22938 | AGGTAGGAGAAG | 1-10-1 MOE | 963 |
| 398142 | 23008 | 23021 | CCAGCACACTGGAA | 2-10-2 MOE | 923 |
| 398147 | 23784 | 23797 | CTACAGGACAATAC | 2-10-2 MOE | 957 |
| 398147 | 23952 | 23965 | CTACAGGACAATAC | 2-10-2 MOE | 957 |
| 147713 | 24434 | 24445 | CTCCCACACCAT | 1-10-1 MOE | 985 |
| 389965 | 24543 | 24554 | CTGCAACATGAT | 1-10-1 MOE | 1018 |
| 147713 | 24602 | 24613 | CTCCCACACCAT | 1-10-1 MOE | 985 |
| 389965 | 24711 | 24722 | CTGCAACATGAT | 1-10-1 MOE | 1018 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147746 | 25384 | 25395 | TAAAAACAACAA | 1-10-1 MOE | 1073 |
| 398143 | 25505 | 25518 | GTCAGTCCCAGCTA | 2-10-2 MOE | 924 |
| 147691 | 25610 | 25621 | GAGGTGGGAAAA | 1-10-1 MOE | 966 |
| 398130 | 25672 | 25685 | TTAGTATGACAGCT | 2-10-2 MOE | 925 |
| 147746 | 25810 | 25821 | TAAAAACAACAA | 1-10-1 MOE | 1073 |
| 147746 | 25978 | 25989 | TAAAAACAACAA | 1-10-1 MOE | 1073 |
| 147746 | 26172 | 26183 | TAAAAACAACAA | 1-10-1 MOE | 1073 |
| 398151 | 26718 | 26731 | TCAGTGTAGGAAGA | 2-10-2 MOE | 926 |
| 147728 | 26917 | 26928 | GCCAGACAGAAG | 1-10-1 MOE | 1013 |
| 398152 | 27708 | 27721 | TGAATATACAGATG | 2-10-2 MOE | 927 |
| 147698 | 28629 | 28640 | CCCGCCACCACC | 1-10-1 MOE | 928 |
| 389965 | 28714 | 28725 | CTGCAACATGAT | 1-10-1 MOE | 1018 |
| 389764 | 28714 | 28725 | CTGCAACATGAT | 1-9-2 MOE | 1018 |
| 389764 | 28861 | 28872 | CTGCAACATGAT | 1-9-2 MOE | 1018 |
| 390030 | 29945 | 29956 | TTTATAAAACTG | 1-10-1 MOE | 1074 |
| 147744 | 30654 | 30665 | AGGAAGGGCTTC | 1-10-1 MOE | 1043 |
| 147093 | 30836 | 30847 | TTGTTCCCTCTA | 1-10-1 MOE | 929 |
| 147746 | 30957 | 30968 | TAAAAACAACAA | 1-10-1 MOE | 1073 |
| 147746 | 31105 | 31116 | TAAAAACAACAA | 1-10-1 MOE | 1073 |
| 390030 | 31477 | 31488 | TTTATAAAACTG | 1-10-1 MOE | 1074 |
| 384545 | 31829 | 31840 | CAAGTAGGATGT | 1-10-1 MOE | 951 |
| 384545 | 31977 | 31988 | CAAGTAGGATGT | 1-10-1 MOE | 951 |
| 401382 | 32094 | 32107 | TCTACCTGAGTCCA | 2-10-2 MOE | 930 |
| 147089 | 32387 | 32398 | TCCCTCTACACC | 1-10-1 MOE | 956 |
| 389950 | 32949 | 32960 | CCCTGAAGGTTC | 1-10-1 MOE | 1063 |
| 398165 | 33002 | 33013 | GTTCTTAGGAAG | 1-10-1 MOE | 968 |
| 147081 | 33073 | 33084 | GCTCCTTCCACT | 1-10-1 MOE | 1006 |
| 147082 | 33074 | 33085 | AGCTCCTTCCAC | 1-10-1 MOE | 1036 |
| 389950 | 33097 | 33108 | CCCTGAAGGTTC | 1-10-1 MOE | 1063 |
| 147736 | 33160 | 33171 | AGGTAGGAGAAG | 1-10-1 MOE | 963 |
| 147081 | 33221 | 33232 | GCTCCTTCCACT | 1-10-1 MOE | 1006 |
| 368360 | 33221 | 33234 | AAGCTCCTTCCACT | 2-10-2 MOE | 1035 |
| 147082 | 33222 | 33233 | AGCTCCTTCCAC | 1-10-1 MOE | 1036 |
| 398138 | 33244 | 33257 | AACATCAAGCTTGA | 2-10-2 MOE | 931 |
| 147746 | 33250 | 33261 | TAAAAACAACAA | 1-10-1 MOE | 1073 |
| 398138 | 33392 | 33405 | AACATCAAGCTTGA | 2-10-2 MOE | 931 |
| 401383 | 33588 | 33601 | GATCACCTTCAGAG | 2-10-2 MOE | 932 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147746 | 33886 | 33897 | TAAAAACAACAA | 1-10-1 MOE | 1073 |
| 147746 | 34606 | 34617 | TAAAAACAACAA | 1-10-1 MOE | 1073 |
| 398165 | 34704 | 34715 | GTTCTTAGGAAG | 1-10-1 MOE | 968 |
| 147717 | 34745 | 34756 | ATCTTCAGAGAT | 1-10-1 MOE | 996 |
| 147746 | 34754 | 34765 | TAAAAACAACAA | 1-10-1 MOE | 1073 |
| 398165 | 34852 | 34863 | GTTCTTAGGAAG | 1-10-1 MOE | 968 |
| 147717 | 34893 | 34904 | ATCTTCAGAGAT | 1-10-1 MOE | 996 |
| 401384 | 34905 | 34918 | TGAACACATCACTA | 2-10-2 MOE | 933 |
| 147738 | 35391 | 35402 | TGGGTGGCCGGG | 1-10-1 MOE | 1069 |
| 147736 | 35396 | 35407 | AGGTAGGAGAAG | 1-10-1 MOE | 963 |
| 147738 | 35539 | 35550 | TGGGTGGCCGGG | 1-10-1 MOE | 1069 |
| 147691 | 35554 | 35565 | GAGGTGGGAAAA | 1-10-1 MOE | 966 |
| 147691 | 35702 | 35713 | GAGGTGGGAAAA | 1-10-1 MOE | 966 |
| 147746 | 35814 | 35825 | TAAAAACAACAA | 1-10-1 MOE | 1073 |
| 401385 | 36109 | 36122 | CCCAGTGGGTTTGA | 2-10-2 MOE | 890 |
| 147691 | 36360 | 36371 | GAGGTGGGAAAA | 1-10-1 MOE | 966 |
| 147746 | 36416 | 36427 | TAAAAACAACAA | 1-10-1 MOE | 1073 |
| 147731 | 36620 | 36631 | TTTCCTCTTGTC | 1-10-1 MOE | 934 |
| 147714 | 37881 | 37892 | TTCTGCTCCCAC | 1-10-1 MOE | 986 |
| 147714 | 38029 | 38040 | TTCTGCTCCCAC | 1-10-1 MOE | 986 |
| 147681 | 38512 | 38523 | ATGTCATTAAAC | 1-10-1 MOE | 965 |
| 401386 | 38516 | 38529 | TAATTGATGTCAAT | 2-10-2 MOE | 935 |
| 401387 | 38518 | 38531 | AGTAATTGATGTCA | 2-10-2 MOE | 936 |
| 401388 | 38520 | 38533 | ACAGTAATTGATGT | 2-10-2 MOE | 937 |
| 401389 | 38522 | 38535 | TTACAGTAATTGAT | 2-10-2 MOE | 938 |
| 401390 | 38524 | 38537 | ACTTACAGTAATTG | 2-10-2 MOE | 939 |
| 401391 | 38526 | 38539 | AGACTTACAGTAAT | 2-10-2 MOE | 940 |
| 401392 | 38528 | 38541 | TCAGACTTACAGTA | 2-10-2 MOE | 941 |
| 401393 | 38530 | 38543 | AATCAGACTTACAG | 2-10-2 MOE | 942 |
| 401394 | 38532 | 38545 | TGAATCAGACTTAC | 2-10-2 MOE | 943 |
| 401395 | 38534 | 38547 | AATGAATCAGACTT | 2-10-2 MOE | 944 |
| 147738 | 38909 | 38920 | TGGGTGGCCGGG | 1-10-1 MOE | 1069 |
| 147738 | 39057 | 39068 | TGGGTGGCCGGG | 1-10-1 MOE | 1069 |
| 390030 | 39249 | 39260 | TTTATAAAACTG | 1-10-1 MOE | 1074 |
| 390030 | 39397 | 39408 | TTTATAAAACTG | 1-10-1 MOE | 1074 |
| 401396 | 39488 | 39501 | TGCAGGATGTTGAG | 2-10-2 MOE | 945 |
| 147717 | 39545 | 39556 | ATCTTCAGAGAT | 1-10-1 MOE | 996 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147746 | 39641 | 39652 | TAAAAACAACAA | 1-10-1 MOE | 1073 |
| 147717 | 39693 | 39704 | ATCTTCAGAGAT | 1-10-1 MOE | 996 |
| 147746 | 39729 | 39740 | TAAAAACAACAA | 1-10-1 MOE | 1073 |
| 147746 | 39877 | 39888 | TAAAAACAACAA | 1-10-1 MOE | 1073 |
| 147746 | 40185 | 40196 | TAAAAACAACAA | 1-10-1 MOE | 1073 |
| 147746 | 40478 | 40489 | TAAAAACAACAA | 1-10-1 MOE | 1073 |
| 398166 | 40589 | 40600 | GGGCTTCTTCCA | 1-10-1 MOE | 1070 |
| 147735 | 40662 | 40673 | GGAGAAGCGCAG | 1-10-1 MOE | 1016 |
| 147746 | 40706 | 40717 | TAAAAACAACAA | 1-10-1 MOE | 1073 |
| 398166 | 40737 | 40748 | GGGCTTCTTCCA | 1-10-1 MOE | 1070 |
| 147746 | 40854 | 40865 | TAAAAACAACAA | 1-10-1 MOE | 1073 |
| 401397 | 41012 | 41025 | CTGGTCAGCATTGA | 2-10-2 MOE | 946 |
| 147718 | 41070 | 41081 | TAATATGACTTG | 1-10-1 MOE | 998 |
| 147718 | 41218 | 41229 | TAATATGACTTG | 1-10-1 MOE | 998 |
| 147717 | 41221 | 41232 | ATCTTCAGAGAT | 1-10-1 MOE | 996 |
| 147717 | 41369 | 41380 | ATCTTCAGAGAT | 1-10-1 MOE | 996 |
| 147717 | 41599 | 41610 | ATCTTCAGAGAT | 1-10-1 MOE | 996 |
| 147717 | 41747 | 41758 | ATCTTCAGAGAT | 1-10-1 MOE | 996 |
| 401398 | 41768 | 41781 | CAAAGTCCCTTAGC | 2-10-2 MOE | 947 |
| 390030 | 42056 | 42067 | TTTATAAAACTG | 1-10-1 MOE | 1074 |
| 398153 | 42157 | 42170 | ATTTCTCTTACAGG | 2-10-2 MOE | 948 |
| 398153 | 42305 | 42318 | ATTTCTCTTACAGG | 2-10-2 MOE | 948 |
| 147710 | 42691 | 42702 | TATAGCTCCTCT | 1-10-1 MOE | 994 |
| 147079 | 43322 | 43333 | TCCTTCCACTGA | 1-10-1 MOE | 1001 |
| 147080 | 43323 | 43334 | CTCCTTCCACTG | 1-10-1 MOE | 1021 |
| 147716 | 43477 | 43488 | TTAACGAGCCTT | 1-10-1 MOE | 949 |
| 147746 | 43992 | 44003 | TAAAAACAACAA | 1-10-1 MOE | 1073 |
| 147736 | 44137 | 44148 | AGGTAGGAGAAG | 1-10-1 MOE | 963 |
| 384545 | 44242 | 44253 | CAAGTAGGATGT | 1-10-1 MOE | 951 |
| 147687 | 44354 | 44365 | CGACACGGGAAC | 1-10-1 MOE | 950 |
| 384545 | 44390 | 44401 | CAAGTAGGATGT | 1-10-1 MOE | 951 |
| 398110 | 44713 | 44726 | GTTCCCTTTGCAGG | 2-10-2 MOE | 952 |
| 147705 | 45092 | 45103 | CGGTTTTTGTTC | 1-10-1 MOE | 1002 |
| 147705 | 45240 | 45251 | CGGTTTTTGTTC | 1-10-1 MOE | 1002 |
| 147074 | 45977 | 45988 | CCACTGATCCTG | 1-10-1 MOE | 845 |
| 147075 | 45978 | 45989 | TCCACTGATCCT | 1-10-1 MOE | 1026 |
| 147076 | 45979 | 45990 | TTCCACTGATCC | 1-10-1 MOE | 1029 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147076 | 46127 | 46138 | TTCCACTGATCC | 1-10-1 MOE | 1029 |
| 401399 | 46247 | 46260 | ATTAGCCATATCTC | 2-10-2 MOE | 953 |
| 147705 | 46555 | 46566 | CGGTTTTTGTTC | 1-10-1 MOE | 1002 |
| 147714 | 46685 | 46696 | TTCTGCTCCCAC | 1-10-1 MOE | 986 |
| 147705 | 46703 | 46714 | CGGTTTTTGTTC | 1-10-1 MOE | 1002 |
| 390030 | 46859 | 46870 | TTTATAAAACTG | 1-10-1 MOE | 1074 |
| 390030 | 46933 | 46944 | TTTATAAAACTG | 1-10-1 MOE | 1074 |
| 147681 | 46984 | 46995 | ATGTCATTAAAC | 1-10-1 MOE | 965 |
| 390030 | 47007 | 47018 | TTTATAAAACTG | 1-10-1 MOE | 1074 |
| 147746 | 47023 | 47034 | TAAAAACAACAA | 1-10-1 MOE | 1073 |
| 390030 | 47081 | 47092 | TTTATAAAACTG | 1-10-1 MOE | 1074 |
| 147681 | 47132 | 47143 | ATGTCATTAAAC | 1-10-1 MOE | 965 |
| 147746 | 47171 | 47182 | TAAAAACAACAA | 1-10-1 MOE | 1073 |
| 401400 | 47411 | 47424 | AGCATTCAGCAGTG | 2-10-2 MOE | 954 |
| 147746 | 47461 | 47472 | TAAAAACAACAA | 1-10-1 MOE | 1073 |
| 147086 | 47608 | 47619 | CTCTACACCAGG | 1-10-1 MOE | 969 |
| 147087 | 47609 | 47620 | CCTCTACACCAG | 1-10-1 MOE | 982 |
| 147088 | 47610 | 47621 | CCCTCTACACCA | 1-10-1 MOE | 1050 |
| 147090 | 47612 | 47623 | TTCCCTCTACAC | 1-10-1 MOE | 955 |
| 147691 | 47729 | 47740 | GAGGTGGGAAAA | 1-10-1 MOE | 966 |
| 147086 | 47756 | 47767 | CTCTACACCAGG | 1-10-1 MOE | 969 |
| 147088 | 47758 | 47769 | CCCTCTACACCA | 1-10-1 MOE | 1050 |
| 147089 | 47759 | 47770 | TCCCTCTACACC | 1-10-1 MOE | 956 |
| 390030 | 47847 | 47858 | TTTATAAAACTG | 1-10-1 MOE | 1074 |
| 390030 | 47995 | 48006 | TTTATAAAACTG | 1-10-1 MOE | 1074 |
| 147691 | 48393 | 48404 | GAGGTGGGAAAA | 1-10-1 MOE | 966 |
| 398147 | 48887 | 48900 | CTACAGGACAATAC | 2-10-2 MOE | 957 |
| 147706 | 49133 | 49144 | GCTGACATCTCG | 1-10-1 MOE | 1071 |
| 147706 | 49281 | 49292 | GCTGACATCTCG | 1-10-1 MOE | 1071 |
| 398168 | 49742 | 49753 | TCGGACTTTGAA | 1-10-1 MOE | 1008 |
| 401401 | 49791 | 49804 | AACTGGGTTAAGTA | 2-10-2 MOE | 958 |
| 147689 | 49936 | 49947 | CAGAGAAGGTCT | 1-10-1 MOE | 987 |
| 401402 | 50192 | 50205 | TGAACACGCTATCC | 2-10-2 MOE | 959 |
| 398117 | 50241 | 50254 | TTTCCACTTGGGTG | 2-10-2 MOE | 960 |
| 147736 | 50582 | 50593 | AGGTAGGAGAAG | 1-10-1 MOE | 963 |
| 398168 | 50703 | 50714 | TCGGACTTTGAA | 1-10-1 MOE | 1008 |
| 398168 | 50849 | 50860 | TCGGACTTTGAA | 1-10-1 MOE | 1008 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147746 | 51019 | 51030 | TAAAAACAACAA | 1-10-1 MOE | 1073 |
| 147708 | 51101 | 51112 | TTGATATAGTCA | 1-10-1 MOE | 997 |
| 147746 | 51178 | 51189 | TAAAAACAACAA | 1-10-1 MOE | 1073 |
| 147708 | 51247 | 51258 | TTGATATAGTCA | 1-10-1 MOE | 997 |
| 147083 | 51281 | 51292 | TACACCAGGTCA | 1-10-1 MOE | 973 |
| 147081 | 51287 | 51298 | GCTCCTTCCACT | 1-10-1 MOE | 1006 |
| 147082 | 51288 | 51299 | AGCTCCTTCCAC | 1-10-1 MOE | 1036 |
| 147746 | 51331 | 51342 | TAAAAACAACAA | 1-10-1 MOE | 1073 |
| 147085 | 51416 | 51427 | TCTACACCAGGT | 1-10-1 MOE | 961 |
| 147083 | 51427 | 51438 | TACACCAGGTCA | 1-10-1 MOE | 973 |
| 147081 | 51433 | 51444 | GCTCCTTCCACT | 1-10-1 MOE | 1006 |
| 147082 | 51434 | 51445 | AGCTCCTTCCAC | 1-10-1 MOE | 1036 |
| 147728 | 51522 | 51533 | GCCAGACAGAAG | 1-10-1 MOE | 1013 |
| 147085 | 51562 | 51573 | TCTACACCAGGT | 1-10-1 MOE | 961 |
| 147081 | 51633 | 51644 | GCTCCTTCCACT | 1-10-1 MOE | 1006 |
| 368360 | 51633 | 51646 | AAGCTCCTTCCACT | 2-10-2 MOE | 1035 |
| 147082 | 51634 | 51645 | AGCTCCTTCCAC | 1-10-1 MOE | 1036 |
| 368361 | 51635 | 51648 | GAAAGCTCCTTCCA | 2-10-2 MOE | 962 |
| 368360 | 51779 | 51792 | AAGCTCCTTCCACT | 2-10-2 MOE | 1035 |
| 147082 | 51780 | 51791 | AGCTCCTTCCAC | 1-10-1 MOE | 1036 |
| 147736 | 51859 | 51870 | AGGTAGGAGAAG | 1-10-1 MOE | 963 |
| 147684 | 51867 | 51878 | ACCCAGTCAGGG | 1-10-1 MOE | 964 |
| 147746 | 51918 | 51929 | TAAAAACAACAA | 1-10-1 MOE | 1073 |
| 147077 | 51988 | 51999 | CTTCCACTGATC | 1-10-1 MOE | 1047 |
| 147746 | 52064 | 52075 | TAAAAACAACAA | 1-10-1 MOE | 1073 |
| 147084 | 52125 | 52136 | CTACACCAGGTC | 1-10-1 MOE | 993 |
| 147079 | 52136 | 52147 | TCCTTCCACTGA | 1-10-1 MOE | 1001 |
| 147681 | 52231 | 52242 | ATGTCATTAAAC | 1-10-1 MOE | 965 |
| 147084 | 52271 | 52282 | CTACACCAGGTC | 1-10-1 MOE | 993 |
| 147691 | 52312 | 52323 | GAGGTGGGAAAA | 1-10-1 MOE | 966 |
| 401403 | 52318 | 52331 | TTTCCTAGGAGGTG | 2-10-2 MOE | 967 |
| 398167 | 52527 | 52538 | CAGGCCATGTGG | 1-10-1 MOE | 1059 |
| 147703 | 52670 | 52681 | TGGCTTCATGTC | 1-10-1 MOE | 971 |
| 398167 | 52673 | 52684 | CAGGCCATGTGG | 1-10-1 MOE | 1059 |
| 398165 | 52708 | 52719 | GTTCTTAGGAAG | 1-10-1 MOE | 968 |
| 398090 | 52708 | 52721 | TTGTTCTTAGGAAG | 2-10-2 MOE | 972 |
| 147705 | 52716 | 52727 | CGGTTTTTGTTC | 1-10-1 MOE | 1002 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147682 | 52717 | 52728 | CGGGTACTATGG | 1-10-1 MOE | 992 |
| 398167 | 52762 | 52773 | CAGGCCATGTGG | 1-10-1 MOE | 1059 |
| 147703 | 52816 | 52827 | TGGCTTCATGTC | 1-10-1 MOE | 971 |
| 398090 | 52854 | 52867 | TTGTTCTTAGGAAG | 2-10-2 MOE | 972 |
| 147704 | 52856 | 52867 | TTGTTCTTAGGA | 1-10-1 MOE | 1012 |
| 147705 | 52862 | 52873 | CGGTTTTGTTC | 1-10-1 MOE | 1002 |
| 398167 | 52908 | 52919 | CAGGCCATGTGG | 1-10-1 MOE | 1059 |
| 147084 | 53704 | 53715 | CTACACCAGGTC | 1-10-1 MOE | 993 |
| 147088 | 53708 | 53719 | CCCTCTACACCA | 1-10-1 MOE | 1050 |
| 147083 | 53849 | 53860 | TACACCAGGTCA | 1-10-1 MOE | 973 |
| 147084 | 53850 | 53861 | CTACACCAGGTC | 1-10-1 MOE | 993 |
| 147086 | 53852 | 53863 | CTCTACACCAGG | 1-10-1 MOE | 969 |
| 147088 | 53854 | 53865 | CCCTCTACACCA | 1-10-1 MOE | 1050 |
| 398167 | 53870 | 53881 | CAGGCCATGTGG | 1-10-1 MOE | 1059 |
| 147703 | 54137 | 54148 | TGGCTTCATGTC | 1-10-1 MOE | 971 |
| 398155 | 54172 | 54185 | TGTTTTTACACAGA | 2-10-2 MOE | 970 |
| 390030 | 54263 | 54274 | TTTATAAAACTG | 1-10-1 MOE | 1074 |
| 147705 | 54275 | 54286 | CGGTTTTGTTC | 1-10-1 MOE | 1002 |
| 147703 | 54283 | 54294 | TGGCTTCATGTC | 1-10-1 MOE | 971 |
| 390030 | 54409 | 54420 | TTTATAAAACTG | 1-10-1 MOE | 1074 |
| 147704 | 54965 | 54976 | TTGTTCTTAGGA | 1-10-1 MOE | 1012 |
| 147705 | 54971 | 54982 | CGGTTTTGTTC | 1-10-1 MOE | 1002 |
| 398090 | 55109 | 55122 | TTGTTCTTAGGAAG | 2-10-2 MOE | 972 |
| 147705 | 55117 | 55128 | CGGTTTTGTTC | 1-10-1 MOE | 1002 |
| 147083 | 55206 | 55217 | TACACCAGGTCA | 1-10-1 MOE | 973 |
| 147084 | 55207 | 55218 | CTACACCAGGTC | 1-10-1 MOE | 993 |
| 147084 | 55353 | 55364 | CTACACCAGGTC | 1-10-1 MOE | 993 |
| 147705 | 55524 | 55535 | CGGTTTTGTTC | 1-10-1 MOE | 1002 |
| 147685 | 55602 | 55613 | GGCTGACATTCA | 1-10-1 MOE | 975 |
| 401404 | 55638 | 55651 | TGAGCTACAGTAGG | 2-10-2 MOE | 974 |
| 147685 | 55748 | 55759 | GGCTGACATTCA | 1-10-1 MOE | 975 |
| 147712 | 55819 | 55830 | ACACCATCTCCC | 1-10-1 MOE | 1005 |
| 147712 | 55965 | 55976 | ACACCATCTCCC | 1-10-1 MOE | 1005 |
| 147707 | 56300 | 56311 | TAGTCATTATCT | 1-10-1 MOE | 977 |
| 147708 | 56306 | 56317 | TTGATATAGTCA | 1-10-1 MOE | 997 |
| 390030 | 56321 | 56332 | TTTATAAAACTG | 1-10-1 MOE | 1074 |
| 147709 | 56326 | 56337 | CCATTTTTATCA | 1-10-1 MOE | 978 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 398091 | 56333 | 56346 | GGGCTTCTTCCATT | 2-10-2 MOE | 979 |
| 401405 | 56408 | 56421 | TGGTCAACTGAAAG | 2-10-2 MOE | 976 |
| 147707 | 56446 | 56457 | TAGTCATTATCT | 1-10-1 MOE | 977 |
| 147708 | 56452 | 56463 | TTGATATAGTCA | 1-10-1 MOE | 997 |
| 147709 | 56472 | 56483 | CCATTTTTATCA | 1-10-1 MOE | 978 |
| 398091 | 56479 | 56492 | GGGCTTCTTCCATT | 2-10-2 MOE | 979 |
| 401406 | 56570 | 56583 | GGTGTGGATAACAG | 2-10-2 MOE | 980 |
| 368366 | 56664 | 56677 | CTGATCCTTAGAAG | 2-10-2 MOE | 1019 |
| 398148 | 57157 | 57170 | TCATAACTATTAAG | 2-10-2 MOE | 981 |
| 147082 | 57220 | 57231 | AGCTCCTTCCAC | 1-10-1 MOE | 1036 |
| 398148 | 57303 | 57316 | TCATAACTATTAAG | 2-10-2 MOE | 981 |
| 147082 | 57366 | 57377 | AGCTCCTTCCAC | 1-10-1 MOE | 1036 |
| 147743 | 57758 | 57769 | AGGGCTTCCAGT | 1-10-1 MOE | 1042 |
| 398093 | 57963 | 57976 | TCGGACTTTGAAAA | 2-10-2 MOE | 1009 |
| 398093 | 58109 | 58122 | TCGGACTTTGAAAA | 2-10-2 MOE | 1009 |
| 147735 | 58279 | 58290 | GGAGAAGCGCAG | 1-10-1 MOE | 1016 |
| 147087 | 58821 | 58832 | CCTCTACACCAG | 1-10-1 MOE | 982 |
| 147087 | 58967 | 58978 | CCTCTACACCAG | 1-10-1 MOE | 982 |
| 390030 | 59180 | 59191 | TTTATAAAACTG | 1-10-1 MOE | 1074 |
| 390030 | 59326 | 59337 | TTTATAAAACTG | 1-10-1 MOE | 1074 |
| 147711 | 59357 | 59368 | AAGGGCCCTGGG | 1-10-1 MOE | 1040 |
| 147743 | 59382 | 59393 | AGGGCTTCCAGT | 1-10-1 MOE | 1042 |
| 147711 | 59503 | 59514 | AAGGGCCCTGGG | 1-10-1 MOE | 1040 |
| 147711 | 59675 | 59686 | AAGGGCCCTGGG | 1-10-1 MOE | 1040 |
| 401407 | 59710 | 59723 | CAGCTTAGGCAGAG | 2-10-2 MOE | 983 |
| 147712 | 59711 | 59722 | ACACCATCTCCC | 1-10-1 MOE | 1005 |
| 147713 | 59716 | 59727 | CTCCCACACCAT | 1-10-1 MOE | 985 |
| 147714 | 59721 | 59732 | TTCTGCTCCCAC | 1-10-1 MOE | 986 |
| 147695 | 59722 | 59733 | TCATTCCCCACT | 1-10-1 MOE | 984 |
| 147715 | 59746 | 59757 | GTTGAGCATGAC | 1-10-1 MOE | 1077 |
| 147711 | 59821 | 59832 | AAGGGCCCTGGG | 1-10-1 MOE | 1040 |
| 390030 | 59847 | 59858 | TTTATAAAACTG | 1-10-1 MOE | 1074 |
| 147712 | 59857 | 59868 | ACACCATCTCCC | 1-10-1 MOE | 1005 |
| 147713 | 59862 | 59873 | CTCCCACACCAT | 1-10-1 MOE | 985 |
| 147714 | 59867 | 59878 | TTCTGCTCCCAC | 1-10-1 MOE | 986 |
| 390030 | 59993 | 60004 | TTTATAAAACTG | 1-10-1 MOE | 1074 |
| 389949 | 60471 | 60482 | GCGCGAGCCCGA | 1-10-1 MOE | 1061 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147746 | 60619 | 60630 | TAAAAACAACAA | 1-10-1 MOE | 1073 |
| 147689 | 61113 | 61124 | CAGAGAAGGTCT | 1-10-1 MOE | 987 |
| 398105 | 61267 | 61280 | TGCACAGGCAGGTT | 2-10-2 MOE | 1066 |
| 147680 | 61473 | 61484 | GTATGCACTGCT | 1-10-1 MOE | 988 |
| 147080 | 61757 | 61768 | CTCCTTCCACTG | 1-10-1 MOE | 1021 |
| 147078 | 61901 | 61912 | CCTTCCACTGAT | 1-10-1 MOE | 1044 |
| 147079 | 61902 | 61913 | TCCTTCCACTGA | 1-10-1 MOE | 1001 |
| 147088 | 62215 | 62226 | CCCTCTACACCA | 1-10-1 MOE | 1050 |
| 401408 | 62600 | 62613 | CAATGAAGCACAGG | 2-10-2 MOE | 989 |
| 147688 | 62843 | 62854 | TCCCAAACAAAT | 1-10-1 MOE | 990 |
| 147746 | 63102 | 63113 | TAAAAACAACAA | 1-10-1 MOE | 1073 |
| 147746 | 63248 | 63259 | TAAAAACAACAA | 1-10-1 MOE | 1073 |
| 401409 | 63430 | 63443 | ATTCTTAACACAGA | 2-10-2 MOE | 991 |
| 147682 | 63483 | 63494 | CGGGTACTATGG | 1-10-1 MOE | 992 |
| 147084 | 63677 | 63688 | CTACACCAGGTC | 1-10-1 MOE | 993 |
| 147710 | 64847 | 64858 | TATAGCTCCTCT | 1-10-1 MOE | 994 |
| 147710 | 64993 | 65004 | TATAGCTCCTCT | 1-10-1 MOE | 994 |
| 147746 | 65151 | 65162 | TAAAAACAACAA | 1-10-1 MOE | 1073 |
| 401410 | 65263 | 65276 | CATTTAGGGTCTAA | 2-10-2 MOE | 995 |
| 147717 | 65862 | 65873 | ATCTTCAGAGAT | 1-10-1 MOE | 996 |
| 147717 | 65895 | 65906 | ATCTTCAGAGAT | 1-10-1 MOE | 996 |
| 147708 | 65900 | 65911 | TTGATATAGTCA | 1-10-1 MOE | 997 |
| 147718 | 65909 | 65920 | TAATATGACTTG | 1-10-1 MOE | 998 |
| 147717 | 66008 | 66019 | ATCTTCAGAGAT | 1-10-1 MOE | 996 |
| 147717 | 66041 | 66052 | ATCTTCAGAGAT | 1-10-1 MOE | 996 |
| 147708 | 66046 | 66057 | TTGATATAGTCA | 1-10-1 MOE | 997 |
| 147718 | 66055 | 66066 | TAATATGACTTG | 1-10-1 MOE | 998 |
| 401411 | 66123 | 66136 | AGCCGCCTGAAGTG | 2-10-2 MOE | 999 |
| 147697 | 66497 | 66508 | CCCCAGCAGCGG | 1-10-1 MOE | 1000 |
| 368377 | 66562 | 66577 | CTCCTTCCACTGATCC | 3-10-3 MOE | 1030 |
| 147077 | 66563 | 66574 | CTTCCACTGATC | 1-10-1 MOE | 1047 |
| 368358 | 66563 | 66576 | TCCTTCCACTGATC | 2-10-2 MOE | 1031 |
| 147078 | 66564 | 66575 | CCTTCCACTGAT | 1-10-1 MOE | 1044 |
| 147079 | 66565 | 66576 | TCCTTCCACTGA | 1-10-1 MOE | 1001 |
| 147080 | 66566 | 66577 | CTCCTTCCACTG | 1-10-1 MOE | 1021 |
| 147697 | 66643 | 66654 | CCCCAGCAGCGG | 1-10-1 MOE | 1000 |
| 368358 | 66709 | 66722 | TCCTTCCACTGATC | 2-10-2 MOE | 1031 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147078 | 66710 | 66721 | CCTTCCACTGAT | 1-10-1 MOE | 1044 |
| 147079 | 66711 | 66722 | TCCTTCCACTGA | 1-10-1 MOE | 1001 |
| 147075 | 66999 | 67010 | TCCACTGATCCT | 1-10-1 MOE | 1026 |
| 147705 | 67067 | 67078 | CGGTTTTGTTC | 1-10-1 MOE | 1002 |
| 147088 | 67409 | 67420 | CCCTCTACACCA | 1-10-1 MOE | 1050 |
| 147080 | 67430 | 67441 | CTCCTTCCACTG | 1-10-1 MOE | 1021 |
| 147082 | 67432 | 67443 | AGCTCCTTCCAC | 1-10-1 MOE | 1036 |
| 147737 | 67455 | 67466 | ACAGCCAGGTAG | 1-10-1 MOE | 1067 |
| 147088 | 67555 | 67566 | CCCTCTACACCA | 1-10-1 MOE | 1050 |
| 147082 | 67578 | 67589 | AGCTCCTTCCAC | 1-10-1 MOE | 1036 |
| 401412 | 67637 | 67650 | TAAATCCTCTAGCA | 2-10-2 MOE | 1003 |
| 147091 | 67729 | 67740 | GTTCCCTCTACA | 1-10-1 MOE | 1004 |
| 147742 | 67737 | 67748 | AACTTCAGTGTC | 1-10-1 MOE | 1041 |
| 147712 | 68527 | 68538 | ACACCATCTCCC | 1-10-1 MOE | 1005 |
| 147712 | 68673 | 68684 | ACACCATCTCCC | 1-10-1 MOE | 1005 |
| 147711 | 68760 | 68771 | AAGGGCCCTGGG | 1-10-1 MOE | 1040 |
| 147711 | 68906 | 68917 | AAGGGCCCTGGG | 1-10-1 MOE | 1040 |
| 389965 | 69271 | 69282 | CTGCAACATGAT | 1-10-1 MOE | 1018 |
| 389965 | 69417 | 69428 | CTGCAACATGAT | 1-10-1 MOE | 1018 |
| 368353 | 69519 | 69532 | CACTGATCCTGCAC | 2-10-2 MOE | 1007 |
| 147080 | 69630 | 69641 | CTCCTTCCACTG | 1-10-1 MOE | 1021 |
| 147081 | 69631 | 69642 | GCTCCTTCCACT | 1-10-1 MOE | 1006 |
| 368353 | 69665 | 69678 | CACTGATCCTGCAC | 2-10-2 MOE | 1007 |
| 398167 | 69757 | 69768 | CAGGCCATGTGG | 1-10-1 MOE | 1059 |
| 398092 | 69758 | 69771 | AGTCAGGCCATGTG | 2-10-2 MOE | 1060 |
| 398093 | 69811 | 69824 | TCGGACTTTGAAAA | 2-10-2 MOE | 1009 |
| 398168 | 69813 | 69824 | TCGGACTTTGAA | 1-10-1 MOE | 1008 |
| 398167 | 69903 | 69914 | CAGGCCATGTGG | 1-10-1 MOE | 1059 |
| 398093 | 69957 | 69970 | TCGGACTTTGAAAA | 2-10-2 MOE | 1009 |
| 398094 | 70047 | 70060 | ATCAGCCAGACAGA | 2-10-2 MOE | 1010 |
| 398095 | 70065 | 70078 | CATCAGCAAGAGGC | 2-10-2 MOE | 1011 |
| 147704 | 70137 | 70148 | TTGTTCTTAGGA | 1-10-1 MOE | 1012 |
| 147728 | 70450 | 70461 | GCCAGACAGAAG | 1-10-1 MOE | 1013 |
| 398164 | 70464 | 70475 | TTGTCGATCTGC | 1-10-1 MOE | 1014 |
| 398096 | 70562 | 70575 | GGAGAAGCGCAGCT | 2-10-2 MOE | 1015 |
| 147735 | 70564 | 70575 | GGAGAAGCGCAG | 1-10-1 MOE | 1016 |
| 147737 | 70575 | 70586 | ACAGCCAGGTAG | 1-10-1 MOE | 1067 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 147735 | 70710 | 70721 | GGAGAAGCGCAG | 1-10-1 MOE | 1016 |
| 147737 | 70721 | 70732 | ACAGCCAGGTAG | 1-10-1 MOE | 1067 |
| 404131 | 70729 | 70742 | ACCTTCGATCACAG | 2-10-2 MOE | 831 |
| 368349 | 70762 | 70775 | CTGCACTGACGAGT | 2-10-2 MOE | 1017 |
| 389965 | 70930 | 70941 | CTGCAACATGAT | 1-10-1 MOE | 1018 |
| 368366 | 70995 | 71008 | CTGATCCTTAGAAG | 2-10-2 MOE | 1019 |
| 368354 | 70999 | 71012 | TCCACTGATCCTGC | 2-10-2 MOE | 1024 |
| 368375 | 71000 | 71015 | CCTTCCACTGATCCTG | 3-10-3 MOE | 1020 |
| 368356 | 71001 | 71014 | CTTCCACTGATCCT | 2-10-2 MOE | 1027 |
| 368376 | 71001 | 71016 | TCCTTCCACTGATCCT | 3-10-3 MOE | 1028 |
| 368357 | 71002 | 71015 | CCTTCCACTGATCC | 2-10-2 MOE | 1046 |
| 368377 | 71002 | 71017 | CTCCTTCCACTGATCC | 3-10-3 MOE | 1030 |
| 147077 | 71003 | 71014 | CTTCCACTGATC | 1-10-1 MOE | 1047 |
| 368358 | 71003 | 71016 | TCCTTCCACTGATC | 2-10-2 MOE | 1031 |
| 368378 | 71003 | 71018 | GCTCCTTCCACTGATC | 3-10-3 MOE | 1032 |
| 147078 | 71004 | 71015 | CCTTCCACTGAT | 1-10-1 MOE | 1044 |
| 368359 | 71005 | 71018 | GCTCCTTCCACTGA | 2-10-2 MOE | 1033 |
| 368379 | 71005 | 71020 | AAGCTCCTTCCACTGA | 3-10-3 MOE | 1034 |
| 147080 | 71006 | 71017 | CTCCTTCCACTG | 1-10-1 MOE | 1021 |
| 147082 | 71008 | 71019 | AGCTCCTTCCAC | 1-10-1 MOE | 1036 |
| 401413 | 71019 | 71032 | TGCAGCCATGTACT | 2-10-2 MOE | 1022 |
| 147738 | 71067 | 71078 | TGGGTGGCCGGG | 1-10-1 MOE | 1069 |
| 147739 | 71071 | 71082 | CGTTTGGGTGGC | 1-10-1 MOE | 1023 |
| 147741 | 71129 | 71140 | CACCCACTGGTG | 1-10-1 MOE | 1055 |
| 368354 | 71145 | 71158 | TCCACTGATCCTGC | 2-10-2 MOE | 1024 |
| 368355 | 71146 | 71159 | TTCCACTGATCCTG | 2-10-2 MOE | 1025 |
| 147075 | 71147 | 71158 | TCCACTGATCCT | 1-10-1 MOE | 1026 |
| 368356 | 71147 | 71160 | CTTCCACTGATCCT | 2-10-2 MOE | 1027 |
| 368376 | 71147 | 71162 | TCCTTCCACTGATCCT | 3-10-3 MOE | 1028 |
| 147076 | 71148 | 71159 | TTCCACTGATCC | 1-10-1 MOE | 1029 |
| 368357 | 71148 | 71161 | CCTTCCACTGATCC | 2-10-2 MOE | 1046 |
| 368377 | 71148 | 71163 | CTCCTTCCACTGATCC | 3-10-3 MOE | 1030 |
| 147077 | 71149 | 71160 | CTTCCACTGATC | 1-10-1 MOE | 1047 |
| 368358 | 71149 | 71162 | TCCTTCCACTGATC | 2-10-2 MOE | 1031 |
| 368378 | 71149 | 71164 | GCTCCTTCCACTGATC | 3-10-3 MOE | 1032 |
| 147078 | 71150 | 71161 | CCTTCCACTGAT | 1-10-1 MOE | 1044 |
| 368359 | 71151 | 71164 | GCTCCTTCCACTGA | 2-10-2 MOE | 1033 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 368379 | 71151 | 71166 | AAGCTCCTTCCACTGA | 3-10-3 MOE | 1034 |
| 368360 | 71153 | 71166 | AAGCTCCTTCCACT | 2-10-2 MOE | 1035 |
| 147082 | 71154 | 71165 | AGCTCCTTCCAC | 1-10-1 MOE | 1036 |
| 368381 | 71155 | 71170 | GGGAAAGCTCCTTCCA | 3-10-3 MOE | 1037 |
| 390030 | 71986 | 71997 | TTTATAAAACTG | 1-10-1 MOE | 1074 |
| 390030 | 72132 | 72143 | TTTATAAAACTG | 1-10-1 MOE | 1074 |
| 147711 | 72300 | 72311 | AAGGGCCCTGGG | 1-10-1 MOE | 1040 |
| 401414 | 72347 | 72360 | TTGCAATGTCTGGC | 2-10-2 MOE | 1038 |
| 147741 | 72400 | 72411 | CACCCACTGGTG | 1-10-1 MOE | 1055 |
| 401415 | 72415 | 72428 | GATTTATCTGGCTG | 2-10-2 MOE | 1039 |
| 147711 | 72446 | 72457 | AAGGGCCCTGGG | 1-10-1 MOE | 1040 |
| 147742 | 72575 | 72586 | AACTTCAGTGTC | 1-10-1 MOE | 1041 |
| 147743 | 72690 | 72701 | AGGGCTTCCAGT | 1-10-1 MOE | 1042 |
| 147744 | 72694 | 72705 | AGGAAGGGCTTC | 1-10-1 MOE | 1043 |
| 147745 | 72700 | 72711 | TTGACCAGGAAG | 1-10-1 MOE | 1058 |
| 147742 | 72721 | 72732 | AACTTCAGTGTC | 1-10-1 MOE | 1041 |
| 147743 | 72836 | 72847 | AGGGCTTCCAGT | 1-10-1 MOE | 1042 |
| 147744 | 72840 | 72851 | AGGAAGGGCTTC | 1-10-1 MOE | 1043 |
| 368357 | 72898 | 72911 | CCTTCCACTGATCC | 2-10-2 MOE | 1046 |
| 147078 | 72900 | 72911 | CCTTCCACTGAT | 1-10-1 MOE | 1044 |
| 398157 | 72903 | 72916 | GGAAACATACCCTG | 2-10-2 MOE | 1045 |
| 368357 | 73044 | 73057 | CCTTCCACTGATCC | 2-10-2 MOE | 1046 |
| 147077 | 73045 | 73056 | CTTCCACTGATC | 1-10-1 MOE | 1047 |
| 147746 | 73052 | 73063 | TAAAAACAACAA | 1-10-1 MOE | 1073 |
| 147746 | 73101 | 73112 | TAAAAACAACAA | 1-10-1 MOE | 1073 |
| 398160 | 73139 | 73152 | GAATAGGTTAAGGC | 2-10-2 MOE | 1048 |
| 147746 | 73198 | 73209 | TAAAAACAACAA | 1-10-1 MOE | 1073 |
| 398161 | 73238 | 73251 | AACAATGTGTTGTA | 2-10-2 MOE | 1049 |
| 147088 | 73419 | 73430 | CCCTCTACACCA | 1-10-1 MOE | 1050 |
| 404140 | 73457 | 73470 | GCACACAGCTGAGG | 2-10-2 MOE | 1051 |
| 404139 | 73459 | 73472 | GTGCACACAGCTGA | 2-10-2 MOE | 1052 |
| 399301 | 73461 | 73474 | GTGTGCACACAGCT | 2-10-2 MOE | 1542 |
| 404137 | 73463 | 73476 | CAGTGTGCACACAG | 2-10-2 MOE | 1053 |
| 404138 | 73465 | 73478 | CTCAGTGTGCACAC | 2-10-2 MOE | 1054 |
| 147741 | 73705 | 73716 | CACCCACTGGTG | 1-10-1 MOE | 1055 |
| 404135 | 73858 | 73871 | CATTTCCATGGCCA | 2-10-2 MOE | 1056 |
| 398167 | 74008 | 74019 | CAGGCCATGTGG | 1-10-1 MOE | 1059 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 398092 | 74009 | 74022 | AGTCAGGCCATGTG | 2-10-2 MOE | 1060 |
| 398162 | 74114 | 74127 | ACCAAACAGTTCAG | 2-10-2 MOE | 1057 |
| 147745 | 74137 | 74148 | TTGACCAGGAAG | 1-10-1 MOE | 1058 |
| 398167 | 74154 | 74165 | CAGGCCATGTGG | 1-10-1 MOE | 1059 |
| 398092 | 74155 | 74168 | AGTCAGGCCATGTG | 2-10-2 MOE | 1060 |
| 389949 | 74310 | 74321 | GCGCGAGCCCGA | 1-10-1 MOE | 1061 |
| 147740 | 74485 | 74496 | TGTGAGGCTCCA | 1-10-1 MOE | 1062 |
| 389950 | 74527 | 74538 | CCCTGAAGGTTC | 1-10-1 MOE | 1063 |
| 398101 | 74656 | 74669 | TTTGATAAAGCCCT | 2-10-2 MOE | 1064 |
| 398104 | 74805 | 74818 | CAAGAAGACCTTAC | 2-10-2 MOE | 1065 |
| 147737 | 74893 | 74904 | ACAGCCAGGTAG | 1-10-1 MOE | 1067 |
| 398105 | 74894 | 74907 | TGCACAGGCAGGTT | 2-10-2 MOE | 1066 |
| 147737 | 74919 | 74930 | ACAGCCAGGTAG | 1-10-1 MOE | 1067 |
| 398106 | 74974 | 74987 | TGGAAAACTGCACC | 2-10-2 MOE | 1068 |
| 404199 | 75045 | 75058 | GGTCATGCACAGGC | 2-10-2 MOE | 867 |
| 404134 | 75048 | 75061 | TCAGGTCATGCACA | 2-10-2 MOE | 873 |
| 398106 | 75120 | 75133 | TGGAAAACTGCACC | 2-10-2 MOE | 1068 |
| 147738 | 75155 | 75166 | TGGGTGGCCGGG | 1-10-1 MOE | 1069 |
| 404132 | 75227 | 75240 | CCTTGGAATGTCTG | 2-10-2 MOE | 852 |
| 147738 | 75301 | 75312 | TGGGTGGCCGGG | 1-10-1 MOE | 1069 |
| 398166 | 75499 | 75510 | GGGCTTCTTCCA | 1-10-1 MOE | 1070 |
| 147746 | 75617 | 75628 | TAAAAACAACAA | 1-10-1 MOE | 1073 |
| 147706 | 75686 | 75697 | GCTGACATCTCG | 1-10-1 MOE | 1071 |
| 398112 | 75730 | 75743 | CAGCCTGGCACCTA | 2-10-2 MOE | 1072 |
| 147746 | 75763 | 75774 | TAAAAACAACAA | 1-10-1 MOE | 1073 |
| 398115 | 75786 | 75799 | AGTAAATATTGGCT | 2-10-2 MOE | 1076 |
| 390030 | 75839 | 75850 | TTTATAAAACTG | 1-10-1 MOE | 1074 |
| 398114 | 75916 | 75929 | AGGCATATAGCAGA | 2-10-2 MOE | 1075 |
| 398115 | 75932 | 75945 | AGTAAATATTGGCT | 2-10-2 MOE | 1076 |
| 404133 | 75968 | 75981 | TATTCCATGGCCAT | 2-10-2 MOE | 872 |
| 147715 | 77045 | 77056 | GTTGAGCATGAC | 1-10-1 MOE | 1077 |
| 147715 | 77190 | 77201 | GTTGAGCATGAC | 1-10-1 MOE | 1077 |
| 147693 | 77385 | 77396 | GTGCGCTCCCAT | 1-10-1 MOE | 1078 |
| 398173 | 40201 | 40212 | CAGCCTGGGCAC | 1-10-1 MOE | 1543 |
| 398173 | 72764 | 72775 | CAGCCTGGGCAC | 1-10-1 MOE | 1543 |
| 399096 | 1986 | 1999 | TGCTCGAACTCCTT | 2-10-2 MOE | 1544 |
| 399102 | 52822 | 52835 | GAAGTCACTGGCTT | 2-10-2 MOE | 1545 |

TABLE 18-continued

Short Antisense Compounds targeted to SEQ ID NO: 12

| ISIS NO. | 5' Target Site | 3' Target Site | Sequence (5'-3') | Gapmer Motif | Seq ID NO |
|---|---|---|---|---|---|
| 399103 | 52824 | 52837 | GGGAAGTCACTGGC | 2-10-2 MOE | 1546 |
| 399113 | 59827 | 59840 | GTTAGGCAAAGGGC | 2-10-2 MOE | 1547 |
| 399132 | 69977 | 69990 | GGGCTGAGTGACCC | 2-10-2 MOE | 1548 |
| 399173 | 74592 | 74605 | ATGCTAGTGCACTA | 2-10-2 MOE | 1549 |
| 399208 | 75900 | 75913 | AGCTCGCTACCTCT | 2-10-2 MOE | 1550 |
| 399276 | 27559 | 27572 | GAGGTATCCCATCT | 2-10-2 MOE | 1551 |
| 399315 | 74039 | 74052 | GGCAACTTCAACCT | 2-10-2 MOE | 1552 |

TABLE 19

Short antisense compounds targeted to SEQ ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 398163 | 20 | 31 | ATGTCAACCGGC | 1-10-1 MOE | 908 |
| 384545 | 23 | 34 | CAAGTAGGATGT | 1-10-1 MOE | 951 |
| 147733 | 26 | 37 | TTCTTGATGTCC | 1-10-1 MOE | 891 |
| 147721 | 59 | 70 | AATGCAGGATCT | 1-10-1 MOE | 1118 |
| 147700 | 110 | 121 | GCGCTAGGCCGC | 1-10-1 MOE | 1110 |
| 384545 | 130 | 141 | CAAGTAGGATGT | 1-10-1 MOE | 951 |
| 147705 | 159 | 170 | CGGTTTTGTTC | 1-10-1 MOE | 1002 |
| 147701 | 167 | 178 | CCATGGCGGGAC | 1-10-1 MOE | 921 |
| 398164 | 198 | 209 | TTGTCGATCTGC | 1-10-1 MOE | 1014 |
| 147730 | 199 | 210 | CTTGTCCATCAG | 1-10-1 MOE | 1121 |
| 147702 | 226 | 237 | CTGGTAAATAGC | 1-10-1 MOE | 898 |
| 147703 | 245 | 256 | TGGCTTCATGTC | 1-10-1 MOE | 971 |
| 147705 | 266 | 277 | CGGTTTTGTTC | 1-10-1 MOE | 1002 |
| 398165 | 283 | 294 | GTTCTTAGGAAG | 1-10-1 MOE | 968 |
| 147704 | 285 | 296 | TTGTTCTTAGGA | 1-10-1 MOE | 1012 |
| 147705 | 291 | 302 | CGGTTTTGTTC | 1-10-1 MOE | 1002 |
| 147709 | 311 | 322 | CCATTTTATCA | 1-10-1 MOE | 978 |
| 147733 | 349 | 360 | TTCTTGATGTCC | 1-10-1 MOE | 891 |
| 147707 | 360 | 371 | TAGTCATTATCT | 1-10-1 MOE | 977 |
| 147708 | 366 | 377 | TTGATATAGTCA | 1-10-1 MOE | 997 |
| 390030 | 381 | 392 | TTTATAAAACTG | 1-10-1 MOE | 1074 |
| 147709 | 386 | 397 | CCATTTTATCA | 1-10-1 MOE | 978 |
| 147081 | 393 | 404 | GCTCCTTCCACT | 1-10-1 MOE | 1006 |
| 398091 | 393 | 406 | GGGCTTCTTCCATT | 2-10-2 MOE | 979 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 398166 | 395 | 406 | GGGCTTCTTCCA | 1-10-1 MOE | 1070 |
| 147712 | 461 | 472 | ACACCATCTCCC | 1-10-1 MOE | 1005 |
| 147713 | 466 | 477 | CTCCCACACCAT | 1-10-1 MOE | 985 |
| 147714 | 471 | 482 | TTCTGCTCCCAC | 1-10-1 MOE | 986 |
| 147710 | 502 | 513 | TATAGCTCCTCT | 1-10-1 MOE | 994 |
| 147736 | 551 | 562 | AGGTAGGAGAAG | 1-10-1 MOE | 963 |
| 147717 | 574 | 585 | ATCTTCAGAGAT | 1-10-1 MOE | 996 |
| 147717 | 607 | 618 | ATCTTCAGAGAT | 1-10-1 MOE | 996 |
| 147710 | 609 | 620 | TATAGCTCCTCT | 1-10-1 MOE | 994 |
| 147708 | 612 | 623 | TTGATATAGTCA | 1-10-1 MOE | 997 |
| 147718 | 621 | 632 | TAATATGACTTG | 1-10-1 MOE | 998 |
| 147746 | 625 | 636 | TAAAAACAACAA | 1-10-1 MOE | 1073 |
| 147736 | 658 | 669 | AGGTAGGAGAAG | 1-10-1 MOE | 963 |
| 147720 | 676 | 687 | GATCTCTCGAGT | 1-10-1 MOE | 1117 |
| 147721 | 683 | 694 | AATGCAGGATCT | 1-10-1 MOE | 1118 |
| 398167 | 704 | 715 | CAGGCCATGTGG | 1-10-1 MOE | 1059 |
| 398092 | 705 | 718 | AGTCAGGCCATGTG | 2-10-2 MOE | 1060 |
| 147722 | 709 | 720 | AAAGTCAGGCCA | 1-10-1 MOE | 1130 |
| 147723 | 715 | 726 | GACTCCAAAGTC | 1-10-1 MOE | 892 |
| 147746 | 733 | 744 | TAAAAACAACAA | 1-10-1 MOE | 1073 |
| 398093 | 758 | 771 | TCGGACTTTGAAAA | 2-10-2 MOE | 1009 |
| 398168 | 760 | 771 | TCGGACTTTGAA | 1-10-1 MOE | 1008 |
| 147725 | 761 | 772 | CTCGGACTTTGA | 1-10-1 MOE | 1119 |
| 147726 | 766 | 777 | TGACTCTCGGAC | 1-10-1 MOE | 1120 |
| 147738 | 780 | 791 | TGGGTGGCCGGG | 1-10-1 MOE | 1069 |
| 147727 | 807 | 818 | CAGTGGACCACA | 1-10-1 MOE | 1128 |
| 147728 | 846 | 857 | GCCAGACAGAAG | 1-10-1 MOE | 1013 |
| 398094 | 848 | 861 | ATCAGCCAGACAGA | 2-10-2 MOE | 1010 |
| 398169 | 849 | 860 | TCAGCCAGACAG | 1-10-1 MOE | 909 |
| 147729 | 863 | 874 | GTAAGAGGCAGG | 1-10-1 MOE | 920 |
| 398095 | 866 | 879 | CATCAGCAAGAGGC | 2-10-2 MOE | 1011 |
| 398164 | 873 | 884 | TTGTCGATCTGC | 1-10-1 MOE | 1014 |
| 147730 | 874 | 885 | CTTGTCCATCAG | 1-10-1 MOE | 1121 |
| 147731 | 880 | 891 | TTTCCTCTTGTC | 1-10-1 MOE | 934 |
| 147732 | 885 | 896 | GGGTCTTTCCTC | 1-10-1 MOE | 1122 |
| 147738 | 888 | 899 | TGGGTGGCCGGG | 1-10-1 MOE | 1069 |
| 147733 | 906 | 917 | TTCTTGATGTCC | 1-10-1 MOE | 891 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 398096 | 971 | 984 | GGAGAAGCGCAGCT | 2-10-2 MOE | 1015 |
| 147735 | 973 | 984 | GGAGAAGCGCAG | 1-10-1 MOE | 1016 |
| 147736 | 978 | 989 | AGGTAGGAGAAG | 1-10-1 MOE | 963 |
| 147729 | 979 | 990 | GTAAGAGGCAGG | 1-10-1 MOE | 920 |
| 147737 | 984 | 995 | ACAGCCAGGTAG | 1-10-1 MOE | 1067 |
| 368349 | 1025 | 1038 | CTGCACTGACGAGT | 2-10-2 MOE | 1017 |
| 368369 | 1025 | 1040 | TCCTGCACTGACGAGT | 3-10-3 MOE | 893 |
| 368350 | 1027 | 1040 | TCCTGCACTGACGA | 2-10-2 MOE | 1079 |
| 368370 | 1027 | 1042 | GATCCTGCACTGACGA | 3-10-3 MOE | 1080 |
| 368351 | 1029 | 1042 | GATCCTGCACTGAC | 2-10-2 MOE | 1081 |
| 368371 | 1029 | 1044 | CTGATCCTGCACTGAC | 3-10-3 MOE | 1082 |
| 368352 | 1031 | 1044 | CTGATCCTGCACTG | 2-10-2 MOE | 1105 |
| 368372 | 1031 | 1046 | CACTGATCCTGCACTG | 3-10-3 MOE | 894 |
| 368353 | 1033 | 1046 | CACTGATCCTGCAC | 2-10-2 MOE | 1007 |
| 368373 | 1033 | 1048 | TCCACTGATCCTGCAC | 3-10-3 MOE | 1083 |
| 368354 | 1035 | 1048 | TCCACTGATCCTGC | 2-10-2 MOE | 1024 |
| 368368 | 1035 | 1048 | TCCACTGATCCTTA | 2-10-2 MOE | 1127 |
| 368374 | 1035 | 1050 | CTTCCACTGATCCTGC | 3-10-3 MOE | 1126 |
| 368388 | 1035 | 1050 | CTTCCACTGATCCTTA | 3-10-3 MOE | 895 |
| 147074 | 1036 | 1047 | CCACTGATCCTG | 1-10-1 MOE | 845 |
| 368355 | 1036 | 1049 | TTCCACTGATCCTG | 2-10-2 MOE | 1025 |
| 368375 | 1036 | 1051 | CCTTCCACTGATCCTG | 3-10-3 MOE | 1020 |
| 147075 | 1037 | 1048 | TCCACTGATCCT | 1-10-1 MOE | 1026 |
| 368356 | 1037 | 1050 | CTTCCACTGATCCT | 2-10-2 MOE | 1027 |
| 368376 | 1037 | 1052 | TCCTTCCACTGATCCT | 3-10-3 MOE | 1028 |
| 147076 | 1038 | 1049 | TTCCACTGATCC | 1-10-1 MOE | 1029 |
| 368357 | 1038 | 1051 | CCTTCCACTGATCC | 2-10-2 MOE | 1046 |
| 368377 | 1038 | 1053 | CTCCTTCCACTGATCC | 3-10-3 MOE | 1030 |
| 147077 | 1039 | 1050 | CTTCCACTGATC | 1-10-1 MOE | 1047 |
| 368358 | 1039 | 1052 | TCCTTCCACTGATC | 2-10-2 MOE | 1031 |
| 368378 | 1039 | 1054 | GCTCCTTCCACTGATC | 3-10-3 MOE | 1032 |
| 147078 | 1040 | 1051 | CCTTCCACTGAT | 1-10-1 MOE | 1044 |
| 147079 | 1041 | 1052 | TCCTTCCACTGA | 1-10-1 MOE | 1001 |
| 368359 | 1041 | 1054 | GCTCCTTCCACTGA | 2-10-2 MOE | 1033 |
| 368379 | 1041 | 1056 | AAGCTCCTTCCACTGA | 3-10-3 MOE | 1034 |
| 147080 | 1042 | 1053 | CTCCTTCCACTG | 1-10-1 MOE | 1021 |
| 147081 | 1043 | 1054 | GCTCCTTCCACT | 1-10-1 MOE | 1006 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 368360 | 1043 | 1056 | AAGCTCCTTCCACT | 2-10-2 MOE | 1035 |
| 368380 | 1043 | 1058 | GAAAGCTCCTTCCACT | 3-10-3 MOE | 896 |
| 147082 | 1044 | 1055 | AGCTCCTTCCAC | 1-10-1 MOE | 1036 |
| 368361 | 1045 | 1058 | GAAAGCTCCTTCCA | 2-10-2 MOE | 962 |
| 368381 | 1045 | 1060 | GGGAAAGCTCCTTCCA | 3-10-3 MOE | 1037 |
| 147729 | 1087 | 1098 | GTAAGAGGCAGG | 1-10-1 MOE | 920 |
| 147738 | 1103 | 1114 | TGGGTGGCCGGG | 1-10-1 MOE | 1069 |
| 147739 | 1107 | 1118 | CGTTTGGGTGGC | 1-10-1 MOE | 1023 |
| 147740 | 1124 | 1135 | TGTGAGGCTCCA | 1-10-1 MOE | 1062 |
| 398117 | 1164 | 1177 | TTTCCACTTGGGTG | 2-10-2 MOE | 960 |
| 147741 | 1165 | 1176 | CACCCACTGGTG | 1-10-1 MOE | 1055 |
| 398097 | 1194 | 1207 | GGCAGTCTTTATCC | 2-10-2 MOE | 897 |
| 398098 | 1272 | 1285 | TAACTTCAGTGTCT | 2-10-2 MOE | 1131 |
| 398117 | 1272 | 1285 | TTTCCACTTGGGTG | 2-10-2 MOE | 960 |
| 147742 | 1273 | 1284 | AACTTCAGTGTC | 1-10-1 MOE | 1041 |
| 147698 | 1293 | 1304 | CCCGCCACCACC | 1-10-1 MOE | 928 |
| 147743 | 1388 | 1399 | AGGGCTTCCAGT | 1-10-1 MOE | 1042 |
| 398099 | 1388 | 1401 | GAAGGGCTTCCAGT | 2-10-2 MOE | 1132 |
| 147744 | 1392 | 1403 | AGGAAGGGCTTC | 1-10-1 MOE | 1043 |
| 398100 | 1395 | 1408 | TGACCAGGAAGGGC | 2-10-2 MOE | 1133 |
| 147745 | 1398 | 1409 | TTGACCAGGAAG | 1-10-1 MOE | 1058 |
| 398157 | 1455 | 1468 | GGAAACATACCCTG | 2-10-2 MOE | 1045 |
| 147745 | 1458 | 1469 | TTGACCAGGAAG | 1-10-1 MOE | 1058 |
| 398167 | 1475 | 1486 | CAGGCCATGTGG | 1-10-1 MOE | 1059 |
| 398118 | 1564 | 1577 | CGCGAGATATCTAA | 2-10-2 MOE | 1084 |
| 147697 | 1575 | 1586 | CCCCAGCAGCGG | 1-10-1 MOE | 1000 |
| 147076 | 1596 | 1607 | TTCCACTGATCC | 1-10-1 MOE | 1029 |
| 368357 | 1596 | 1609 | CCTTCCACTGATCC | 2-10-2 MOE | 1046 |
| 147077 | 1597 | 1608 | CTTCCACTGATC | 1-10-1 MOE | 1047 |
| 147078 | 1598 | 1609 | CCTTCCACTGAT | 1-10-1 MOE | 1044 |
| 398118 | 1672 | 1685 | CGCGAGATATCTAA | 2-10-2 MOE | 1084 |
| 398158 | 1681 | 1694 | AGGCCCTGAGATTA | 2-10-2 MOE | 1134 |
| 147697 | 1683 | 1694 | CCCCAGCAGCGG | 1-10-1 MOE | 1000 |
| 398159 | 1686 | 1699 | GGTTAAGGCCCTGA | 2-10-2 MOE | 1135 |
| 398160 | 1691 | 1704 | GAATAGGTTAAGGC | 2-10-2 MOE | 1048 |
| 398163 | 1711 | 1722 | ATGTCAACCGGC | 1-10-1 MOE | 908 |
| 147733 | 1717 | 1728 | TTCTTGATGTCC | 1-10-1 MOE | 891 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147089 | 1747 | 1758 | TCCCTCTACACC | 1-10-1 MOE | 956 |
| 147090 | 1748 | 1759 | TTCCCTCTACAC | 1-10-1 MOE | 955 |
| 147746 | 1750 | 1761 | TAAAACAACAA | 1-10-1 MOE | 1073 |
| 389949 | 1777 | 1788 | GCGCGAGCCCGA | 1-10-1 MOE | 1061 |
| 398161 | 1790 | 1803 | AACAATGTGTTGTA | 2-10-2 MOE | 1049 |
| 147746 | 1799 | 1810 | TAAAACAACAA | 1-10-1 MOE | 1073 |
| 147700 | 1801 | 1812 | GCGCTAGGCCGC | 1-10-1 MOE | 1110 |
| 147740 | 1806 | 1817 | TGTGAGGCTCCA | 1-10-1 MOE | 1062 |
| 398163 | 1819 | 1830 | ATGTCAACCGGC | 1-10-1 MOE | 908 |
| 147733 | 1825 | 1836 | TTCTTGATGTCC | 1-10-1 MOE | 891 |
| 389950 | 1848 | 1859 | CCCTGAAGGTTC | 1-10-1 MOE | 1063 |
| 147701 | 1858 | 1869 | CCATGGCGGGAC | 1-10-1 MOE | 921 |
| 398164 | 1889 | 1900 | TTGTCGATCTGC | 1-10-1 MOE | 1014 |
| 147730 | 1890 | 1901 | CTTGTCCATCAG | 1-10-1 MOE | 1121 |
| 147700 | 1909 | 1920 | GCGCTAGGCCGC | 1-10-1 MOE | 1110 |
| 398119 | 1920 | 1933 | CGCACCTGGTAAAT | 2-10-2 MOE | 1085 |
| 147685 | 1957 | 1968 | GGCTGACATTCA | 1-10-1 MOE | 975 |
| 147701 | 1966 | 1977 | CCATGGCGGGAC | 1-10-1 MOE | 921 |
| 398120 | 1966 | 1979 | GTTCAAGCGGCTA | 2-10-2 MOE | 1086 |
| 398101 | 1977 | 1990 | TTTGATAAAGCCCT | 2-10-2 MOE | 1064 |
| 398164 | 1997 | 2008 | TTGTCGATCTGC | 1-10-1 MOE | 1014 |
| 147730 | 1998 | 2009 | CTTGTCCATCAG | 1-10-1 MOE | 1121 |
| 147702 | 2025 | 2036 | CTGGTAAATAGC | 1-10-1 MOE | 898 |
| 398119 | 2028 | 2041 | CGCACCTGGTAAAT | 2-10-2 MOE | 1085 |
| 398120 | 2074 | 2087 | GTTCAAGCGGCTA | 2-10-2 MOE | 1086 |
| 398105 | 2099 | 2112 | TGCACAGGCAGGTT | 2-10-2 MOE | 1066 |
| 147736 | 2204 | 2215 | AGGTAGGAGAAG | 1-10-1 MOE | 963 |
| 147741 | 2257 | 2268 | CACCCACTGGTG | 1-10-1 MOE | 1055 |
| 398104 | 2272 | 2285 | CAAGAAGACCTTAC | 2-10-2 MOE | 1065 |
| 147737 | 2360 | 2371 | ACAGCCAGGTAG | 1-10-1 MOE | 1067 |
| 398105 | 2361 | 2374 | TGCACAGGCAGGTT | 2-10-2 MOE | 1066 |
| 147737 | 2386 | 2397 | ACAGCCAGGTAG | 1-10-1 MOE | 1067 |
| 398095 | 2407 | 2420 | CATCAGCAAGAGGC | 2-10-2 MOE | 1011 |
| 398106 | 2441 | 2454 | TGGAAAACTGCACC | 2-10-2 MOE | 1068 |
| 398107 | 2447 | 2460 | TATTCCTGGAAAAC | 2-10-2 MOE | 902 |
| 398121 | 2474 | 2487 | GTGCCTAGCACAGA | 2-10-2 MOE | 1097 |
| 147745 | 2497 | 2508 | TTGACCAGGAAG | 1-10-1 MOE | 1058 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147712 | 2499 | 2510 | ACACCATCTCCC | 1-10-1 MOE | 1005 |
| 398108 | 2544 | 2557 | GGAATGTCTGAGTT | 2-10-2 MOE | 1136 |
| 147691 | 2575 | 2586 | GAGGTGGGAAAA | 1-10-1 MOE | 966 |
| 398121 | 2582 | 2595 | GTGCCTAGCACAGA | 2-10-2 MOE | 1097 |
| 147738 | 2622 | 2633 | TGGGTGGCCGGG | 1-10-1 MOE | 1069 |
| 398162 | 2666 | 2679 | ACCAAACAGTTCAG | 2-10-2 MOE | 1057 |
| 147745 | 2689 | 2700 | TTGACCAGGAAG | 1-10-1 MOE | 1058 |
| 398167 | 2706 | 2717 | CAGGCCATGTGG | 1-10-1 MOE | 1059 |
| 398092 | 2707 | 2720 | AGTCAGGCCATGTG | 2-10-2 MOE | 1060 |
| 398109 | 2714 | 2727 | CAAGAAGTGTGGTT | 2-10-2 MOE | 903 |
| 398110 | 2852 | 2865 | GTTCCCTTTGCAGG | 2-10-2 MOE | 952 |
| 147091 | 2854 | 2865 | GTTCCCTCTACA | 1-10-1 MOE | 1004 |
| 147723 | 2924 | 2935 | GACTCCAAAGTC | 1-10-1 MOE | 892 |
| 398111 | 2937 | 2950 | GTGAAAATGCTGGC | 2-10-2 MOE | 904 |
| 398166 | 2966 | 2977 | GGGCTTCTTCCA | 1-10-1 MOE | 1070 |
| 147089 | 2978 | 2989 | TCCCTCTACACC | 1-10-1 MOE | 956 |
| 147090 | 2979 | 2990 | TTCCCTCTACAC | 1-10-1 MOE | 955 |
| 147706 | 3007 | 3018 | GCTGACATCTCG | 1-10-1 MOE | 1071 |
| 389949 | 3008 | 3019 | GCGCGAGCCCGA | 1-10-1 MOE | 1061 |
| 147723 | 3032 | 3043 | GACTCCAAAGTC | 1-10-1 MOE | 892 |
| 147740 | 3037 | 3048 | TGTGAGGCTCCA | 1-10-1 MOE | 1062 |
| 398112 | 3051 | 3064 | CAGCCTGGCACCTA | 2-10-2 MOE | 1072 |
| 389950 | 3079 | 3090 | CCCTGAAGGTTC | 1-10-1 MOE | 1063 |
| 147746 | 3084 | 3095 | TAAAAACAACAA | 1-10-1 MOE | 1073 |
| 398122 | 3148 | 3161 | CCCTTTACACAAGT | 2-10-2 MOE | 1087 |
| 147089 | 3151 | 3162 | TCCCTCTACACC | 1-10-1 MOE | 956 |
| 147090 | 3152 | 3163 | TTCCCTCTACAC | 1-10-1 MOE | 955 |
| 398113 | 3160 | 3173 | AGGAGGTTAAACCA | 2-10-2 MOE | 905 |
| 147685 | 3188 | 3199 | GGCTGACATTCA | 1-10-1 MOE | 975 |
| 398101 | 3208 | 3221 | TTTGATAAAGCCCT | 2-10-2 MOE | 1064 |
| 398102 | 3234 | 3247 | CTACCTGAGGATTT | 2-10-2 MOE | 899 |
| 398123 | 3235 | 3248 | CTCAAAATAGATTT | 2-10-2 MOE | 1088 |
| 398114 | 3237 | 3250 | AGGCATATAGCAGA | 2-10-2 MOE | 1075 |
| 398103 | 3241 | 3254 | CCCAGTACTACCTG | 2-10-2 MOE | 900 |
| 398115 | 3253 | 3266 | AGTAAATATTGGCT | 2-10-2 MOE | 1076 |
| 398122 | 3256 | 3269 | CCCTTTACACAAGT | 2-10-2 MOE | 1087 |
| 147089 | 3259 | 3270 | TCCCTCTACACC | 1-10-1 MOE | 956 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147090 | 3260 | 3271 | TTCCCTCTACAC | 1-10-1 MOE | 955 |
| 398116 | 3266 | 3279 | TAATGACCTGATGA | 2-10-2 MOE | 1137 |
| 390030 | 3306 | 3317 | TTTATAAAACTG | 1-10-1 MOE | 1074 |
| 398123 | 3343 | 3356 | CTCAAAATAGATTT | 2-10-2 MOE | 1088 |
| 147736 | 3435 | 3446 | AGGTAGGAGAAG | 1-10-1 MOE | 963 |
| 398104 | 3503 | 3516 | CAAGAAGACCTTAC | 2-10-2 MOE | 1065 |
| 147737 | 3591 | 3602 | ACAGCCAGGTAG | 1-10-1 MOE | 1067 |
| 398105 | 3592 | 3605 | TGCACAGGCAGGTT | 2-10-2 MOE | 1066 |
| 147719 | 3608 | 3619 | CCAACTCCAACT | 1-10-1 MOE | 1116 |
| 147737 | 3617 | 3628 | ACAGCCAGGTAG | 1-10-1 MOE | 1067 |
| 401398 | 3621 | 3634 | CAAAGTCCCTTAGC | 2-10-2 MOE | 947 |
| 147079 | 3637 | 3648 | TCCTTCCACTGA | 1-10-1 MOE | 1001 |
| 147080 | 3638 | 3649 | CTCCTTCCACTG | 1-10-1 MOE | 1021 |
| 398095 | 3638 | 3651 | CATCAGCAAGAGGC | 2-10-2 MOE | 1011 |
| 398106 | 3672 | 3685 | TGGAAAACTGCACC | 2-10-2 MOE | 1068 |
| 147733 | 3687 | 3698 | TTCTTGATGTCC | 1-10-1 MOE | 891 |
| 147731 | 3688 | 3699 | TTTCCTCTTGTC | 1-10-1 MOE | 934 |
| 147719 | 3716 | 3727 | CCAACTCCAACT | 1-10-1 MOE | 1116 |
| 147745 | 3728 | 3739 | TTGACCAGGAAG | 1-10-1 MOE | 1058 |
| 147683 | 3740 | 3751 | GCTTACGATTGT | 1-10-1 MOE | 922 |
| 147079 | 3745 | 3756 | TCCTTCCACTGA | 1-10-1 MOE | 1001 |
| 147080 | 3746 | 3757 | CTCCTTCCACTG | 1-10-1 MOE | 1021 |
| 398108 | 3775 | 3788 | GGAATGTCTGAGTT | 2-10-2 MOE | 1136 |
| 147733 | 3795 | 3806 | TTCTTGATGTCC | 1-10-1 MOE | 891 |
| 147731 | 3796 | 3807 | TTTCCTCTTGTC | 1-10-1 MOE | 934 |
| 147691 | 3806 | 3817 | GAGGTGGGAAAA | 1-10-1 MOE | 966 |
| 147738 | 3853 | 3864 | TGGGTGGCCGGG | 1-10-1 MOE | 1069 |
| 398167 | 3926 | 3937 | CAGGCCATGTGG | 1-10-1 MOE | 1059 |
| 147691 | 3978 | 3989 | GAGGTGGGAAAA | 1-10-1 MOE | 966 |
| 398167 | 4034 | 4045 | CAGGCCATGTGG | 1-10-1 MOE | 1059 |
| 147091 | 4085 | 4096 | GTTCCCTCTACA | 1-10-1 MOE | 1004 |
| 147691 | 4086 | 4097 | GAGGTGGGAAAA | 1-10-1 MOE | 966 |
| 398111 | 4168 | 4181 | GTGAAAATGCTGGC | 2-10-2 MOE | 904 |
| 398166 | 4197 | 4208 | GGGCTTCTTCCA | 1-10-1 MOE | 1070 |
| 147091 | 4223 | 4234 | GTTCCCTCTACA | 1-10-1 MOE | 1004 |
| 147092 | 4224 | 4235 | TGTTCCCTCTAC | 1-10-1 MOE | 901 |
| 398112 | 4282 | 4295 | CAGCCTGGCACCTA | 2-10-2 MOE | 1072 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147746 | 4315 | 4326 | TAAAAACAACAA | 1-10-1 MOE | 1073 |
| 398113 | 4391 | 4404 | AGGAGGTTAAACCA | 2-10-2 MOE | 905 |
| 147723 | 4422 | 4433 | GACTCCAAAGTC | 1-10-1 MOE | 892 |
| 398114 | 4468 | 4481 | AGGCATATAGCAGA | 2-10-2 MOE | 1075 |
| 398115 | 4484 | 4497 | AGTAAATATTGGCT | 2-10-2 MOE | 1076 |
| 390030 | 4491 | 4502 | TTTATAAAACTG | 1-10-1 MOE | 1074 |
| 398116 | 4497 | 4510 | TAATGACCTGATGA | 2-10-2 MOE | 1137 |
| 147723 | 4530 | 4541 | GACTCCAAAGTC | 1-10-1 MOE | 892 |
| 390030 | 4599 | 4610 | TTTATAAAACTG | 1-10-1 MOE | 1074 |
| 398124 | 4761 | 4774 | CACATGAGCTATTC | 2-10-2 MOE | 1089 |
| 398124 | 4869 | 4882 | CACATGAGCTATTC | 2-10-2 MOE | 1089 |
| 147703 | 4926 | 4937 | TGGCTTCATGTC | 1-10-1 MOE | 971 |
| 147692 | 4928 | 4939 | CTCACCTTCATG | 1-10-1 MOE | 1113 |
| 147696 | 4975 | 4986 | TGGATGATTGGC | 1-10-1 MOE | 906 |
| 147703 | 5034 | 5045 | TGGCTTCATGTC | 1-10-1 MOE | 971 |
| 147692 | 5036 | 5047 | CTCACCTTCATG | 1-10-1 MOE | 1113 |
| 147098 | 5173 | 5184 | AGTTGTTGTTCC | 1-10-1 MOE | 1112 |
| 398125 | 5183 | 5196 | CAGTAAGGAATTTT | 2-10-2 MOE | 913 |
| 398126 | 5216 | 5229 | GTGAAGTGAGTCAT | 2-10-2 MOE | 1090 |
| 147098 | 5281 | 5292 | AGTTGTTGTTCC | 1-10-1 MOE | 1112 |
| 398127 | 5283 | 5296 | GGTCACTCAAGATG | 2-10-2 MOE | 1091 |
| 398126 | 5324 | 5337 | GTGAAGTGAGTCAT | 2-10-2 MOE | 1090 |
| 398128 | 5335 | 5348 | CTAAATTTAGTTCA | 2-10-2 MOE | 911 |
| 398127 | 5391 | 5404 | GGTCACTCAAGATG | 2-10-2 MOE | 1091 |
| 398128 | 5443 | 5456 | CTAAATTTAGTTCA | 2-10-2 MOE | 911 |
| 147712 | 5474 | 5485 | ACACCATCTCCC | 1-10-1 MOE | 1005 |
| 147736 | 5600 | 5611 | AGGTAGGAGAAG | 1-10-1 MOE | 963 |
| 147746 | 5606 | 5617 | TAAAAACAACAA | 1-10-1 MOE | 1073 |
| 398129 | 5628 | 5641 | TTTGAGGAGCTATT | 2-10-2 MOE | 1106 |
| 147085 | 5654 | 5665 | TCTACACCAGGT | 1-10-1 MOE | 961 |
| 147736 | 5708 | 5719 | AGGTAGGAGAAG | 1-10-1 MOE | 963 |
| 398129 | 5736 | 5749 | TTTGAGGAGCTATT | 2-10-2 MOE | 1106 |
| 147679 | 5934 | 5945 | CAAAAGGATCCC | 1-10-1 MOE | 907 |
| 147723 | 6229 | 6240 | GACTCCAAAGTC | 1-10-1 MOE | 892 |
| 147723 | 6338 | 6349 | GACTCCAAAGTC | 1-10-1 MOE | 892 |
| 390030 | 6803 | 6814 | TTTATAAAACTG | 1-10-1 MOE | 1074 |
| 398142 | 6885 | 6898 | CCAGCACACTGGAA | 2-10-2 MOE | 923 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 390030 | 6912 | 6923 | TTTATAAAACTG | 1-10-1 MOE | 1074 |
| 398142 | 6994 | 7007 | CCAGCACACTGGAA | 2-10-2 MOE | 923 |
| 147695 | 7054 | 7065 | TCATTCCCCACT | 1-10-1 MOE | 984 |
| 147695 | 7163 | 7174 | TCATTCCCCACT | 1-10-1 MOE | 984 |
| 398166 | 7197 | 7208 | GGGCTTCTTCCA | 1-10-1 MOE | 1070 |
| 398166 | 7306 | 7317 | GGGCTTCTTCCA | 1-10-1 MOE | 1070 |
| 147684 | 7442 | 7453 | ACCCAGTCAGGG | 1-10-1 MOE | 964 |
| 398130 | 7694 | 7707 | TTAGTATGACAGCT | 2-10-2 MOE | 925 |
| 398131 | 7711 | 7724 | GGACTCACTCAGCA | 2-10-2 MOE | 1092 |
| 398130 | 7802 | 7815 | TTAGTATGACAGCT | 2-10-2 MOE | 925 |
| 398125 | 7804 | 7817 | CAGTAAGGAATTTT | 2-10-2 MOE | 913 |
| 398131 | 7819 | 7832 | GGACTCACTCAGCA | 2-10-2 MOE | 1092 |
| 390030 | 7877 | 7888 | TTTATAAAACTG | 1-10-1 MOE | 1074 |
| 398125 | 7912 | 7925 | CAGTAAGGAATTTT | 2-10-2 MOE | 913 |
| 390030 | 7985 | 7996 | TTTATAAAACTG | 1-10-1 MOE | 1074 |
| 398132 | 8031 | 8044 | TCAGGGCTACTCAT | 2-10-2 MOE | 1093 |
| 398132 | 8139 | 8152 | TCAGGGCTACTCAT | 2-10-2 MOE | 1093 |
| 147684 | 8148 | 8159 | ACCCAGTCAGGG | 1-10-1 MOE | 964 |
| 147684 | 8256 | 8267 | ACCCAGTCAGGG | 1-10-1 MOE | 964 |
| 398163 | 8365 | 8376 | ATGTCAACCGGC | 1-10-1 MOE | 908 |
| 398166 | 8447 | 8458 | GGGCTTCTTCCA | 1-10-1 MOE | 1070 |
| 398163 | 8473 | 8484 | ATGTCAACCGGC | 1-10-1 MOE | 908 |
| 398166 | 8555 | 8566 | GGGCTTCTTCCA | 1-10-1 MOE | 1070 |
| 147718 | 8631 | 8642 | TAATATGACTTG | 1-10-1 MOE | 998 |
| 147691 | 8698 | 8709 | GAGGTGGGAAAA | 1-10-1 MOE | 966 |
| 147691 | 8806 | 8817 | GAGGTGGGAAAA | 1-10-1 MOE | 966 |
| 147728 | 8835 | 8846 | GCCAGACAGAAG | 1-10-1 MOE | 1013 |
| 147727 | 8876 | 8887 | CAGTGGACCACA | 1-10-1 MOE | 1128 |
| 147728 | 8943 | 8954 | GCCAGACAGAAG | 1-10-1 MOE | 1013 |
| 398169 | 8946 | 8957 | TCAGCCAGACAG | 1-10-1 MOE | 909 |
| 147727 | 8984 | 8995 | CAGTGGACCACA | 1-10-1 MOE | 1128 |
| 147742 | 9060 | 9071 | AACTTCAGTGTC | 1-10-1 MOE | 1041 |
| 398133 | 9112 | 9125 | CAGCACTAGATTCA | 2-10-2 MOE | 1094 |
| 384545 | 9135 | 9146 | CAAGTAGGATGT | 1-10-1 MOE | 951 |
| 147742 | 9168 | 9179 | AACTTCAGTGTC | 1-10-1 MOE | 1041 |
| 398133 | 9220 | 9233 | CAGCACTAGATTCA | 2-10-2 MOE | 1094 |
| 384545 | 9243 | 9254 | CAAGTAGGATGT | 1-10-1 MOE | 951 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 398125 | 9368 | 9381 | CAGTAAGGAATTTT | 2-10-2 MOE | 913 |
| 398125 | 9476 | 9489 | CAGTAAGGAATTTT | 2-10-2 MOE | 913 |
| 401409 | 9516 | 9529 | ATTCTTAACACAGA | 2-10-2 MOE | 991 |
| 147096 | 9594 | 9605 | TTGTTGTTCCCT | 1-10-1 MOE | 1107 |
| 147733 | 9597 | 9608 | TTCTTGATGTCC | 1-10-1 MOE | 891 |
| 147720 | 9689 | 9700 | GATCTCTCGAGT | 1-10-1 MOE | 1117 |
| 147096 | 9702 | 9713 | TTGTTGTTCCCT | 1-10-1 MOE | 1107 |
| 147733 | 9705 | 9716 | TTCTTGATGTCC | 1-10-1 MOE | 891 |
| 147720 | 9797 | 9808 | GATCTCTCGAGT | 1-10-1 MOE | 1117 |
| 147746 | 9963 | 9974 | TAAAAACAACAA | 1-10-1 MOE | 1073 |
| 147746 | 9966 | 9977 | TAAAAACAACAA | 1-10-1 MOE | 1073 |
| 147746 | 9969 | 9980 | TAAAAACAACAA | 1-10-1 MOE | 1073 |
| 147746 | 9991 | 10002 | TAAAAACAACAA | 1-10-1 MOE | 1073 |
| 147746 | 10071 | 10082 | TAAAAACAACAA | 1-10-1 MOE | 1073 |
| 147746 | 10074 | 10085 | TAAAAACAACAA | 1-10-1 MOE | 1073 |
| 147746 | 10077 | 10088 | TAAAAACAACAA | 1-10-1 MOE | 1073 |
| 147746 | 10099 | 10110 | TAAAAACAACAA | 1-10-1 MOE | 1073 |
| 398134 | 10153 | 10166 | TAGCTTAATGTAAC | 2-10-2 MOE | 1095 |
| 147085 | 10221 | 10232 | TCTACACCAGGT | 1-10-1 MOE | 961 |
| 398134 | 10261 | 10274 | TAGCTTAATGTAAC | 2-10-2 MOE | 1095 |
| 390030 | 10278 | 10289 | TTTATAAAACTG | 1-10-1 MOE | 1074 |
| 147084 | 10328 | 10339 | CTACACCAGGTC | 1-10-1 MOE | 993 |
| 147711 | 10684 | 10695 | AAGGGCCCTGGG | 1-10-1 MOE | 1040 |
| 398128 | 11333 | 11346 | CTAAATTTAGTTCA | 2-10-2 MOE | 911 |
| 398128 | 11340 | 11353 | CTAAATTTAGTTCA | 2-10-2 MOE | 911 |
| 147730 | 11783 | 11794 | CTTGTCCATCAG | 1-10-1 MOE | 1121 |
| 147731 | 11789 | 11800 | TTTCCTCTTGTC | 1-10-1 MOE | 934 |
| 147730 | 11790 | 11801 | CTTGTCCATCAG | 1-10-1 MOE | 1121 |
| 147731 | 11796 | 11807 | TTTCCTCTTGTC | 1-10-1 MOE | 934 |
| 147707 | 11960 | 11971 | TAGTCATTATCT | 1-10-1 MOE | 977 |
| 147090 | 12008 | 12019 | TTCCCTCTACAC | 1-10-1 MOE | 955 |
| 147091 | 12009 | 12020 | GTTCCCTCTACA | 1-10-1 MOE | 1004 |
| 147091 | 12014 | 12025 | GTTCCCTCTACA | 1-10-1 MOE | 1004 |
| 398096 | 12141 | 12154 | GGAGAAGCGCAGCT | 2-10-2 MOE | 1015 |
| 147735 | 12143 | 12154 | GGAGAAGCGCAG | 1-10-1 MOE | 1016 |
| 398096 | 12146 | 12159 | GGAGAAGCGCAGCT | 2-10-2 MOE | 1015 |
| 147735 | 12148 | 12159 | GGAGAAGCGCAG | 1-10-1 MOE | 1016 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 398166 | 12209 | 12220 | GGGCTTCTTCCA | 1-10-1 MOE | 1070 |
| 398166 | 12214 | 12225 | GGGCTTCTTCCA | 1-10-1 MOE | 1070 |
| 398135 | 12303 | 12316 | GACTACATTTTACA | 2-10-2 MOE | 912 |
| 147741 | 12389 | 12400 | CACCCACTGGTG | 1-10-1 MOE | 1055 |
| 147741 | 12394 | 12405 | CACCCACTGGTG | 1-10-1 MOE | 1055 |
| 398125 | 12431 | 12444 | CAGTAAGGAATTTT | 2-10-2 MOE | 913 |
| 147714 | 12585 | 12596 | TTCTGCTCCCAC | 1-10-1 MOE | 986 |
| 147718 | 12594 | 12605 | TAATATGACTTG | 1-10-1 MOE | 998 |
| 398125 | 12612 | 12625 | CAGTAAGGAATTTT | 2-10-2 MOE | 913 |
| 147737 | 12803 | 12814 | ACAGCCAGGTAG | 1-10-1 MOE | 1067 |
| 147746 | 12876 | 12887 | TAAAACAACAA | 1-10-1 MOE | 1073 |
| 147691 | 12900 | 12911 | GAGGTGGGAAAA | 1-10-1 MOE | 966 |
| 398136 | 12915 | 12928 | TTGTGACATCTAGG | 2-10-2 MOE | 1096 |
| 147737 | 12984 | 12995 | ACAGCCAGGTAG | 1-10-1 MOE | 1067 |
| 147746 | 13057 | 13068 | TAAAACAACAA | 1-10-1 MOE | 1073 |
| 147691 | 13081 | 13092 | GAGGTGGGAAAA | 1-10-1 MOE | 966 |
| 398136 | 13096 | 13109 | TTGTGACATCTAGG | 2-10-2 MOE | 1096 |
| 398138 | 13254 | 13267 | AACATCAAGCTTGA | 2-10-2 MOE | 931 |
| 398138 | 13435 | 13448 | AACATCAAGCTTGA | 2-10-2 MOE | 931 |
| 147691 | 13488 | 13499 | GAGGTGGGAAAA | 1-10-1 MOE | 966 |
| 147681 | 13659 | 13670 | ATGTCATTAAAC | 1-10-1 MOE | 965 |
| 147691 | 13669 | 13680 | GAGGTGGGAAAA | 1-10-1 MOE | 966 |
| 389965 | 13839 | 13850 | CTGCAACATGAT | 1-10-1 MOE | 1018 |
| 389764 | 13839 | 13850 | CTGCAACATGAT | 1-9-2 MOE | 1018 |
| 147681 | 13840 | 13851 | ATGTCATTAAAC | 1-10-1 MOE | 965 |
| 389965 | 14020 | 14031 | CTGCAACATGAT | 1-10-1 MOE | 1018 |
| 389764 | 14020 | 14031 | CTGCAACATGAT | 1-9-2 MOE | 1018 |
| 389948 | 14067 | 14078 | CCGTTGGACCCC | 1-10-1 MOE | 915 |
| 147736 | 14123 | 14134 | AGGTAGGAGAAG | 1-10-1 MOE | 963 |
| 389948 | 14248 | 14259 | CCGTTGGACCCC | 1-10-1 MOE | 915 |
| 147738 | 14279 | 14290 | TGGGTGGCCGGG | 1-10-1 MOE | 1069 |
| 147736 | 14304 | 14315 | AGGTAGGAGAAG | 1-10-1 MOE | 963 |
| 147731 | 14411 | 14422 | TTTCCTCTTGTC | 1-10-1 MOE | 934 |
| 147738 | 14461 | 14472 | TGGGTGGCCGGG | 1-10-1 MOE | 1069 |
| 147692 | 14475 | 14486 | CTCACCTTCATG | 1-10-1 MOE | 1113 |
| 147731 | 14593 | 14604 | TTTCCTCTTGTC | 1-10-1 MOE | 934 |
| 389950 | 14614 | 14625 | CCCTGAAGGTTC | 1-10-1 MOE | 1063 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147692 | 14657 | 14668 | CTCACCTTCATG | 1-10-1 MOE | 1113 |
| 147717 | 14750 | 14761 | ATCTTCAGAGAT | 1-10-1 MOE | 996 |
| 147698 | 14754 | 14765 | CCCGCCACCACC | 1-10-1 MOE | 928 |
| 389950 | 14796 | 14807 | CCCTGAAGGTTC | 1-10-1 MOE | 1063 |
| 398112 | 14863 | 14876 | CAGCCTGGCACCTA | 2-10-2 MOE | 1072 |
| 398121 | 14875 | 14888 | GTGCCTAGCACAGA | 2-10-2 MOE | 1097 |
| 147717 | 14932 | 14943 | ATCTTCAGAGAT | 1-10-1 MOE | 996 |
| 398112 | 15045 | 15058 | CAGCCTGGCACCTA | 2-10-2 MOE | 1072 |
| 398121 | 15057 | 15070 | GTGCCTAGCACAGA | 2-10-2 MOE | 1097 |
| 147730 | 15117 | 15128 | CTTGTCCATCAG | 1-10-1 MOE | 1121 |
| 147730 | 15299 | 15310 | CTTGTCCATCAG | 1-10-1 MOE | 1121 |
| 401407 | 15339 | 15352 | CAGCTTAGGCAGAG | 2-10-2 MOE | 983 |
| 398167 | 15556 | 15567 | CAGGCCATGTGG | 1-10-1 MOE | 1059 |
| 147736 | 16444 | 16455 | AGGTAGGAGAAG | 1-10-1 MOE | 963 |
| 147746 | 16510 | 16521 | TAAAAACAACAA | 1-10-1 MOE | 1073 |
| 147738 | 16590 | 16601 | TGGGTGGCCGGG | 1-10-1 MOE | 1069 |
| 147736 | 16610 | 16621 | AGGTAGGAGAAG | 1-10-1 MOE | 963 |
| 398167 | 16631 | 16642 | CAGGCCATGTGG | 1-10-1 MOE | 1059 |
| 401411 | 16657 | 16670 | AGCCGCCTGAAGTG | 2-10-2 MOE | 999 |
| 147746 | 16676 | 16687 | TAAAAACAACAA | 1-10-1 MOE | 1073 |
| 398144 | 16745 | 16758 | GACAGCTTCTATAA | 2-10-2 MOE | 916 |
| 147738 | 16756 | 16767 | TGGGTGGCCGGG | 1-10-1 MOE | 1069 |
| 398167 | 16797 | 16808 | CAGGCCATGTGG | 1-10-1 MOE | 1059 |
| 398144 | 16911 | 16924 | GACAGCTTCTATAA | 2-10-2 MOE | 916 |
| 389965 | 17096 | 17107 | CTGCAACATGAT | 1-10-1 MOE | 1018 |
| 389764 | 17096 | 17107 | CTGCAACATGAT | 1-9-2 MOE | 1018 |
| 389965 | 17264 | 17275 | CTGCAACATGAT | 1-10-1 MOE | 1018 |
| 389764 | 17264 | 17275 | CTGCAACATGAT | 1-9-2 MOE | 1018 |
| 147709 | 17406 | 17417 | CCATTTTTATCA | 1-10-1 MOE | 978 |
| 147745 | 17443 | 17454 | TTGACCAGGAAG | 1-10-1 MOE | 1058 |
| 147746 | 17497 | 17508 | TAAAAACAACAA | 1-10-1 MOE | 1073 |
| 147720 | 17589 | 17600 | GATCTCTCGAGT | 1-10-1 MOE | 1117 |
| 147745 | 17611 | 17622 | TTGACCAGGAAG | 1-10-1 MOE | 1058 |
| 147695 | 17634 | 17645 | TCATTCCCCACT | 1-10-1 MOE | 984 |
| 147746 | 17665 | 17676 | TAAAAACAACAA | 1-10-1 MOE | 1073 |
| 147088 | 17707 | 17718 | CCCTCTACACCA | 1-10-1 MOE | 1050 |
| 147720 | 17757 | 17768 | GATCTCTCGAGT | 1-10-1 MOE | 1117 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147711 | 17808 | 17819 | AAGGGCCCTGGG | 1-10-1 MOE | 1040 |
| 147711 | 17976 | 17987 | AAGGGCCCTGGG | 1-10-1 MOE | 1040 |
| 398139 | 18049 | 18062 | AGTGACTGACCACA | 2-10-2 MOE | 917 |
| 398139 | 18217 | 18230 | AGTGACTGACCACA | 2-10-2 MOE | 917 |
| 398140 | 18596 | 18609 | GTAGCATAGAGCCT | 2-10-2 MOE | 918 |
| 398140 | 18764 | 18777 | GTAGCATAGAGCCT | 2-10-2 MOE | 918 |
| 398167 | 18927 | 18938 | CAGGCCATGTGG | 1-10-1 MOE | 1059 |
| 398167 | 19095 | 19106 | CAGGCCATGTGG | 1-10-1 MOE | 1059 |
| 147724 | 19147 | 19158 | GAAATTGAGGAA | 1-10-1 MOE | 1139 |
| 147746 | 19207 | 19218 | TAAAACAACAA | 1-10-1 MOE | 1073 |
| 147724 | 19315 | 19326 | GAAATTGAGGAA | 1-10-1 MOE | 1139 |
| 147740 | 19348 | 19359 | TGTGAGGCTCCA | 1-10-1 MOE | 1062 |
| 147746 | 19375 | 19386 | TAAAACAACAA | 1-10-1 MOE | 1073 |
| 147729 | 19386 | 19397 | GTAAGAGGCAGG | 1-10-1 MOE | 920 |
| 147701 | 19503 | 19514 | CCATGGCGGGAC | 1-10-1 MOE | 921 |
| 147711 | 19508 | 19519 | AAGGGCCCTGGG | 1-10-1 MOE | 1040 |
| 147740 | 19516 | 19527 | TGTGAGGCTCCA | 1-10-1 MOE | 1062 |
| 147718 | 19617 | 19628 | TAATATGACTTG | 1-10-1 MOE | 998 |
| 390030 | 19618 | 19629 | TTTATAAAACTG | 1-10-1 MOE | 1074 |
| 147679 | 19635 | 19646 | CAAAAGGATCCC | 1-10-1 MOE | 907 |
| 147711 | 19676 | 19687 | AAGGGCCCTGGG | 1-10-1 MOE | 1040 |
| 147694 | 19747 | 19758 | CAGCCTACCAGT | 1-10-1 MOE | 1098 |
| 147718 | 19785 | 19796 | TAATATGACTTG | 1-10-1 MOE | 998 |
| 390030 | 19786 | 19797 | TTTATAAAACTG | 1-10-1 MOE | 1074 |
| 147679 | 19803 | 19814 | CAAAAGGATCCC | 1-10-1 MOE | 907 |
| 147698 | 19852 | 19863 | CCCGCCACCACC | 1-10-1 MOE | 928 |
| 147694 | 19915 | 19926 | CAGCCTACCAGT | 1-10-1 MOE | 1098 |
| 147704 | 20011 | 20022 | TTGTTCTTAGGA | 1-10-1 MOE | 1012 |
| 147698 | 20020 | 20031 | CCCGCCACCACC | 1-10-1 MOE | 928 |
| 398142 | 20485 | 20498 | CCAGCACACTGGAA | 2-10-2 MOE | 923 |
| 147078 | 20514 | 20525 | CCTTCCACTGAT | 1-10-1 MOE | 1044 |
| 147079 | 20515 | 20526 | TCCTTCCACTGA | 1-10-1 MOE | 1001 |
| 147080 | 20516 | 20527 | CTCCTTCCACTG | 1-10-1 MOE | 1021 |
| 398143 | 20561 | 20574 | GTCAGTCCCAGCTA | 2-10-2 MOE | 924 |
| 389965 | 20620 | 20631 | CTGCAACATGAT | 1-10-1 MOE | 1018 |
| 389764 | 20620 | 20631 | CTGCAACATGAT | 1-9-2 MOE | 1018 |
| 398142 | 20653 | 20666 | CCAGCACACTGGAA | 2-10-2 MOE | 923 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147078 | 20682 | 20693 | CCTTCCACTGAT | 1-10-1 MOE | 1044 |
| 147079 | 20683 | 20694 | TCCTTCCACTGA | 1-10-1 MOE | 1001 |
| 147080 | 20684 | 20695 | CTCCTTCCACTG | 1-10-1 MOE | 1021 |
| 147080 | 20704 | 20715 | CTCCTTCCACTG | 1-10-1 MOE | 1021 |
| 147081 | 20705 | 20716 | GCTCCTTCCACT | 1-10-1 MOE | 1006 |
| 398143 | 20729 | 20742 | GTCAGTCCCAGCTA | 2-10-2 MOE | 924 |
| 389965 | 20788 | 20799 | CTGCAACATGAT | 1-10-1 MOE | 1018 |
| 389764 | 20788 | 20799 | CTGCAACATGAT | 1-9-2 MOE | 1018 |
| 147746 | 20870 | 20881 | TAAAAACAACAA | 1-10-1 MOE | 1073 |
| 147080 | 20872 | 20883 | CTCCTTCCACTG | 1-10-1 MOE | 1021 |
| 147081 | 20873 | 20884 | GCTCCTTCCACT | 1-10-1 MOE | 1006 |
| 147746 | 21038 | 21049 | TAAAAACAACAA | 1-10-1 MOE | 1073 |
| 147717 | 21080 | 21091 | ATCTTCAGAGAT | 1-10-1 MOE | 996 |
| 147076 | 21222 | 21233 | TTCCACTGATCC | 1-10-1 MOE | 1029 |
| 147076 | 21390 | 21401 | TTCCACTGATCC | 1-10-1 MOE | 1029 |
| 398094 | 21441 | 21454 | ATCAGCCAGACAGA | 2-10-2 MOE | 1010 |
| 147746 | 21465 | 21476 | TAAAAACAACAA | 1-10-1 MOE | 1073 |
| 398094 | 21609 | 21622 | ATCAGCCAGACAGA | 2-10-2 MOE | 1010 |
| 398169 | 21610 | 21621 | TCAGCCAGACAG | 1-10-1 MOE | 909 |
| 147746 | 21633 | 21644 | TAAAAACAACAA | 1-10-1 MOE | 1073 |
| 147738 | 21884 | 21895 | TGGGTGGCCGGG | 1-10-1 MOE | 1069 |
| 147743 | 22045 | 22056 | AGGGCTTCCAGT | 1-10-1 MOE | 1042 |
| 147738 | 22052 | 22063 | TGGGTGGCCGGG | 1-10-1 MOE | 1069 |
| 147683 | 22107 | 22118 | GCTTACGATTGT | 1-10-1 MOE | 922 |
| 147743 | 22213 | 22224 | AGGGCTTCCAGT | 1-10-1 MOE | 1042 |
| 147681 | 22566 | 22577 | ATGTCATTAAAC | 1-10-1 MOE | 965 |
| 389950 | 22619 | 22630 | CCCTGAAGGTTC | 1-10-1 MOE | 1063 |
| 147681 | 22734 | 22745 | ATGTCATTAAAC | 1-10-1 MOE | 965 |
| 147736 | 22759 | 22770 | AGGTAGGAGAAG | 1-10-1 MOE | 963 |
| 389950 | 22787 | 22798 | CCCTGAAGGTTC | 1-10-1 MOE | 1063 |
| 389949 | 22794 | 22805 | GCGCGAGCCCGA | 1-10-1 MOE | 1061 |
| 147736 | 22927 | 22938 | AGGTAGGAGAAG | 1-10-1 MOE | 963 |
| 389949 | 22962 | 22973 | GCGCGAGCCCGA | 1-10-1 MOE | 1061 |
| 398144 | 22962 | 22975 | GACAGCTTCTATAA | 2-10-2 MOE | 916 |
| 398142 | 23008 | 23021 | CCAGCACACTGGAA | 2-10-2 MOE | 923 |
| 147727 | 23019 | 23030 | CAGTGGACCACA | 1-10-1 MOE | 1128 |
| 398169 | 23064 | 23075 | TCAGCCAGACAG | 1-10-1 MOE | 909 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 398144 | 23130 | 23143 | GACAGCTTCTATAA | 2-10-2 MOE | 916 |
| 398145 | 23154 | 23167 | ACATGTCAGTAATT | 2-10-2 MOE | 1099 |
| 398142 | 23176 | 23189 | CCAGCACACTGGAA | 2-10-2 MOE | 923 |
| 147727 | 23187 | 23198 | CAGTGGACCACA | 1-10-1 MOE | 1128 |
| 147735 | 23243 | 23254 | GGAGAAGCGCAG | 1-10-1 MOE | 1016 |
| 398145 | 23322 | 23335 | ACATGTCAGTAATT | 2-10-2 MOE | 1099 |
| 147735 | 23411 | 23422 | GGAGAAGCGCAG | 1-10-1 MOE | 1016 |
| 398146 | 23478 | 23491 | CTCATGGACACAAA | 2-10-2 MOE | 1100 |
| 398146 | 23646 | 23659 | CTCATGGACACAAA | 2-10-2 MOE | 1100 |
| 398147 | 23784 | 23797 | CTACAGGACAATAC | 2-10-2 MOE | 957 |
| 398114 | 23853 | 23866 | AGGCATATAGCAGA | 2-10-2 MOE | 1075 |
| 398147 | 23952 | 23965 | CTACAGGACAATAC | 2-10-2 MOE | 957 |
| 398114 | 24021 | 24034 | AGGCATATAGCAGA | 2-10-2 MOE | 1075 |
| 147702 | 24319 | 24330 | CTGGTAAATAGC | 1-10-1 MOE | 898 |
| 147702 | 24487 | 24498 | CTGGTAAATAGC | 1-10-1 MOE | 898 |
| 389965 | 24543 | 24554 | CTGCAACATGAT | 1-10-1 MOE | 1018 |
| 389764 | 24543 | 24554 | CTGCAACATGAT | 1-9-2 MOE | 1018 |
| 147713 | 24602 | 24613 | CTCCCACACCAT | 1-10-1 MOE | 985 |
| 389965 | 24711 | 24722 | CTGCAACATGAT | 1-10-1 MOE | 1018 |
| 389764 | 24711 | 24722 | CTGCAACATGAT | 1-9-2 MOE | 1018 |
| 147684 | 24918 | 24929 | ACCCAGTCAGGG | 1-10-1 MOE | 964 |
| 147684 | 25086 | 25097 | ACCCAGTCAGGG | 1-10-1 MOE | 964 |
| 398148 | 25152 | 25165 | TCATAACTATTAAG | 2-10-2 MOE | 981 |
| 398144 | 25192 | 25205 | GACAGCTTCTATAA | 2-10-2 MOE | 916 |
| 147746 | 25216 | 25227 | TAAAACAACAA | 1-10-1 MOE | 1073 |
| 147736 | 25313 | 25324 | AGGTAGGAGAAG | 1-10-1 MOE | 963 |
| 398148 | 25320 | 25333 | TCATAACTATTAAG | 2-10-2 MOE | 981 |
| 398143 | 25337 | 25350 | GTCAGTCCCAGCTA | 2-10-2 MOE | 924 |
| 398144 | 25360 | 25373 | GACAGCTTCTATAA | 2-10-2 MOE | 916 |
| 147746 | 25384 | 25395 | TAAAACAACAA | 1-10-1 MOE | 1073 |
| 147691 | 25442 | 25453 | GAGGTGGGAAAA | 1-10-1 MOE | 966 |
| 147736 | 25481 | 25492 | AGGTAGGAGAAG | 1-10-1 MOE | 963 |
| 398130 | 25504 | 25517 | TTAGTATGACAGCT | 2-10-2 MOE | 925 |
| 147691 | 25610 | 25621 | GAGGTGGGAAAA | 1-10-1 MOE | 966 |
| 147721 | 25662 | 25673 | AATGCAGGATCT | 1-10-1 MOE | 1118 |
| 398130 | 25672 | 25685 | TTAGTATGACAGCT | 2-10-2 MOE | 925 |
| 147688 | 25750 | 25761 | TCCCAAACAAAT | 1-10-1 MOE | 990 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147746 | 25810 | 25821 | TAAAAACAACAA | 1-10-1 MOE | 1073 |
| 147721 | 25830 | 25841 | AATGCAGGATCT | 1-10-1 MOE | 1118 |
| 147688 | 25918 | 25929 | TCCCAAACAAAT | 1-10-1 MOE | 990 |
| 147746 | 25978 | 25989 | TAAAAACAACAA | 1-10-1 MOE | 1073 |
| 147746 | 26172 | 26183 | TAAAAACAACAA | 1-10-1 MOE | 1073 |
| 147746 | 26340 | 26351 | TAAAAACAACAA | 1-10-1 MOE | 1073 |
| 398149 | 26492 | 26505 | GGAAGTTTTCAAGT | 2-10-2 MOE | 1101 |
| 398150 | 26526 | 26539 | GAATCTGGAGGTAA | 2-10-2 MOE | 1102 |
| 398149 | 26641 | 26654 | GGAAGTTTTCAAGT | 2-10-2 MOE | 1101 |
| 398150 | 26675 | 26688 | GAATCTGGAGGTAA | 2-10-2 MOE | 1102 |
| 147729 | 26712 | 26723 | GTAAGAGGCAGG | 1-10-1 MOE | 920 |
| 398151 | 26718 | 26731 | TCAGTGTAGGAAGA | 2-10-2 MOE | 926 |
| 147729 | 26861 | 26872 | GTAAGAGGCAGG | 1-10-1 MOE | 920 |
| 398151 | 26867 | 26880 | TCAGTGTAGGAAGA | 2-10-2 MOE | 926 |
| 147728 | 26917 | 26928 | GCCAGACAGAAG | 1-10-1 MOE | 1013 |
| 147728 | 27066 | 27077 | GCCAGACAGAAG | 1-10-1 MOE | 1013 |
| 147076 | 27258 | 27269 | TTCCACTGATCC | 1-10-1 MOE | 1029 |
| 147731 | 27267 | 27278 | TTTCCTCTTGTC | 1-10-1 MOE | 934 |
| 147076 | 27407 | 27418 | TTCCACTGATCC | 1-10-1 MOE | 1029 |
| 147731 | 27416 | 27427 | TTTCCTCTTGTC | 1-10-1 MOE | 934 |
| 398152 | 27559 | 27572 | TGAATATACAGATG | 2-10-2 MOE | 927 |
| 398152 | 27708 | 27721 | TGAATATACAGATG | 2-10-2 MOE | 927 |
| 147696 | 28265 | 28276 | TGGATGATTGGC | 1-10-1 MOE | 906 |
| 147696 | 28414 | 28425 | TGGATGATTGGC | 1-10-1 MOE | 906 |
| 147698 | 28481 | 28492 | CCCGCCACCACC | 1-10-1 MOE | 928 |
| 147720 | 28662 | 28673 | GATCTCTCGAGT | 1-10-1 MOE | 1117 |
| 389965 | 28714 | 28725 | CTGCAACATGAT | 1-10-1 MOE | 1018 |
| 389764 | 28714 | 28725 | CTGCAACATGAT | 1-9-2 MOE | 1018 |
| 389965 | 28861 | 28872 | CTGCAACATGAT | 1-10-1 MOE | 1018 |
| 389764 | 28861 | 28872 | CTGCAACATGAT | 1-9-2 MOE | 1018 |
| 398153 | 28980 | 28993 | ATTTCTCTTACAGG | 2-10-2 MOE | 948 |
| 398153 | 29126 | 29139 | ATTTCTCTTACAGG | 2-10-2 MOE | 948 |
| 147719 | 29570 | 29581 | CCAACTCCAACT | 1-10-1 MOE | 1116 |
| 398154 | 29692 | 29705 | AGCCCCTTGGCCGT | 2-10-2 MOE | 1103 |
| 147719 | 29715 | 29726 | CCAACTCCAACT | 1-10-1 MOE | 1116 |
| 398155 | 29785 | 29798 | TGTTTTTACACAGA | 2-10-2 MOE | 970 |
| 398154 | 29837 | 29850 | AGCCCCTTGGCCGT | 2-10-2 MOE | 1103 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 401384 | 29905 | 29918 | TGAACACATCACTA | 2-10-2 MOE | 933 |
| 398155 | 29930 | 29943 | TGTTTTTACACAGA | 2-10-2 MOE | 970 |
| 390030 | 29945 | 29956 | TTTATAAAACTG | 1-10-1 MOE | 1074 |
| 390030 | 30090 | 30101 | TTTATAAAACTG | 1-10-1 MOE | 1074 |
| 398156 | 30141 | 30154 | GAATACTTCAAATC | 2-10-2 MOE | 1104 |
| 398156 | 30286 | 30299 | GAATACTTCAAATC | 2-10-2 MOE | 1104 |
| 389948 | 30384 | 30395 | CCGTTGGACCCC | 1-10-1 MOE | 915 |
| 389948 | 30530 | 30541 | CCGTTGGACCCC | 1-10-1 MOE | 915 |
| 398142 | 30591 | 30604 | CCAGCACACTGGAA | 2-10-2 MOE | 923 |
| 147744 | 30654 | 30665 | AGGAAGGGCTTC | 1-10-1 MOE | 1043 |
| 147093 | 30689 | 30700 | TTGTTCCCTCTA | 1-10-1 MOE | 929 |
| 398142 | 30738 | 30751 | CCAGCACACTGGAA | 2-10-2 MOE | 923 |
| 147744 | 30801 | 30812 | AGGAAGGGCTTC | 1-10-1 MOE | 1043 |
| 398168 | 31082 | 31093 | TCGGACTTTGAA | 1-10-1 MOE | 1008 |
| 147746 | 31105 | 31116 | TAAAACAACAA | 1-10-1 MOE | 1073 |
| 398168 | 31230 | 31241 | TCGGACTTTGAA | 1-10-1 MOE | 1008 |
| 390030 | 31329 | 31340 | TTTATAAAACTG | 1-10-1 MOE | 1074 |
| 147736 | 31458 | 31469 | AGGTAGGAGAAG | 1-10-1 MOE | 963 |
| 390030 | 31477 | 31488 | TTTATAAAACTG | 1-10-1 MOE | 1074 |
| 147736 | 31606 | 31617 | AGGTAGGAGAAG | 1-10-1 MOE | 963 |
| 147698 | 31713 | 31724 | CCCGCCACCACC | 1-10-1 MOE | 928 |
| 384545 | 31829 | 31840 | CAAGTAGGATGT | 1-10-1 MOE | 951 |
| 147698 | 31861 | 31872 | CCCGCCACCACC | 1-10-1 MOE | 928 |
| 147723 | 31941 | 31952 | GACTCCAAAGTC | 1-10-1 MOE | 892 |
| 384545 | 31977 | 31988 | CAAGTAGGATGT | 1-10-1 MOE | 951 |
| 147692 | 32061 | 32072 | CTCACCTTCATG | 1-10-1 MOE | 1113 |
| 147723 | 32089 | 32100 | GACTCCAAAGTC | 1-10-1 MOE | 892 |
| 147692 | 32209 | 32220 | CTCACCTTCATG | 1-10-1 MOE | 1113 |
| 147089 | 32535 | 32546 | TCCCTCTACACC | 1-10-1 MOE | 956 |
| 401396 | 32569 | 32582 | TGCAGGATGTTGAG | 2-10-2 MOE | 945 |
| 147730 | 32714 | 32725 | CTTGTCCATCAG | 1-10-1 MOE | 1121 |
| 398165 | 32854 | 32865 | GTTCTTAGGAAG | 1-10-1 MOE | 968 |
| 147730 | 32862 | 32873 | CTTGTCCATCAG | 1-10-1 MOE | 1121 |
| 389950 | 32949 | 32960 | CCCTGAAGGTTC | 1-10-1 MOE | 1063 |
| 398165 | 33002 | 33013 | GTTCTTAGGAAG | 1-10-1 MOE | 968 |
| 147736 | 33012 | 33023 | AGGTAGGAGAAG | 1-10-1 MOE | 963 |
| 368352 | 33056 | 33069 | CTGATCCTGCACTG | 2-10-2 MOE | 1105 |

TABLE 19-continued

Short antisense compounds targeted to SEQ ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147081 | 33073 | 33084 | GCTCCTTCCACT | 1-10-1 MOE | 1006 |
| 368360 | 33073 | 33086 | AAGCTCCTTCCACT | 2-10-2 MOE | 1035 |
| 147082 | 33074 | 33085 | AGCTCCTTCCAC | 1-10-1 MOE | 1036 |
| 389950 | 33097 | 33108 | CCCTGAAGGTTC | 1-10-1 MOE | 1063 |
| 147736 | 33160 | 33171 | AGGTAGGAGAAG | 1-10-1 MOE | 963 |
| 368352 | 33204 | 33217 | CTGATCCTGCACTG | 2-10-2 MOE | 1105 |
| 147081 | 33221 | 33232 | GCTCCTTCCACT | 1-10-1 MOE | 1006 |
| 147082 | 33222 | 33233 | AGCTCCTTCCAC | 1-10-1 MOE | 1036 |
| 398138 | 33244 | 33257 | AACATCAAGCTTGA | 2-10-2 MOE | 931 |
| 147746 | 33250 | 33261 | TAAAAACAACAA | 1-10-1 MOE | 1073 |
| 398138 | 33392 | 33405 | AACATCAAGCTTGA | 2-10-2 MOE | 931 |
| 147746 | 33398 | 33409 | TAAAAACAACAA | 1-10-1 MOE | 1073 |
| 147732 | 33652 | 33663 | GGGTCTTTCCTC | 1-10-1 MOE | 1122 |
| 147724 | 33733 | 33744 | GAAATTGAGGAA | 1-10-1 MOE | 1139 |
| 147732 | 33800 | 33811 | GGGTCTTTCCTC | 1-10-1 MOE | 1122 |
| 147724 | 33881 | 33892 | GAAATTGAGGAA | 1-10-1 MOE | 1139 |
| 147719 | 33976 | 33987 | CCAACTCCAACT | 1-10-1 MOE | 1116 |
| 147746 | 34034 | 34045 | TAAAAACAACAA | 1-10-1 MOE | 1073 |
| 398129 | 34045 | 34058 | TTTGAGGAGCTATT | 2-10-2 MOE | 1106 |
| 147719 | 34124 | 34135 | CCAACTCCAACT | 1-10-1 MOE | 1116 |
| 147721 | 34156 | 34167 | AATGCAGGATCT | 1-10-1 MOE | 1118 |
| 398129 | 34193 | 34206 | TTTGAGGAGCTATT | 2-10-2 MOE | 1106 |
| 147721 | 34304 | 34315 | AATGCAGGATCT | 1-10-1 MOE | 1118 |
| 147746 | 34606 | 34617 | TAAAAACAACAA | 1-10-1 MOE | 1073 |
| 398165 | 34704 | 34715 | GTTCTTAGGAAG | 1-10-1 MOE | 968 |
| 147746 | 34754 | 34765 | TAAAAACAACAA | 1-10-1 MOE | 1073 |
| 398165 | 34852 | 34863 | GTTCTTAGGAAG | 1-10-1 MOE | 968 |
| 147717 | 34893 | 34904 | ATCTTCAGAGAT | 1-10-1 MOE | 996 |
| 147719 | 34976 | 34987 | CCAACTCCAACT | 1-10-1 MOE | 1116 |
| 147092 | 34987 | 34998 | TGTTCCCTCTAC | 1-10-1 MOE | 901 |
| 147719 | 35124 | 35135 | CCAACTCCAACT | 1-10-1 MOE | 1116 |
| 147092 | 35135 | 35146 | TGTTCCCTCTAC | 1-10-1 MOE | 901 |
| 147736 | 35248 | 35259 | AGGTAGGAGAAG | 1-10-1 MOE | 963 |
| 147738 | 35391 | 35402 | TGGGTGGCCGGG | 1-10-1 MOE | 1069 |
| 147736 | 35396 | 35407 | AGGTAGGAGAAG | 1-10-1 MOE | 963 |
| 147738 | 35539 | 35550 | TGGGTGGCCGGG | 1-10-1 MOE | 1069 |
| 147691 | 35554 | 35565 | GAGGTGGGAAAA | 1-10-1 MOE | 966 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147691 | 35702 | 35713 | GAGGTGGGAAAA | 1-10-1 MOE | 966 |
| 147746 | 35814 | 35825 | TAAAAACAACAA | 1-10-1 MOE | 1073 |
| 147733 | 35889 | 35900 | TTCTTGATGTCC | 1-10-1 MOE | 891 |
| 147733 | 35923 | 35934 | TTCTTGATGTCC | 1-10-1 MOE | 891 |
| 147746 | 35962 | 35973 | TAAAAACAACAA | 1-10-1 MOE | 1073 |
| 147726 | 35978 | 35989 | TGACTCTCGGAC | 1-10-1 MOE | 1120 |
| 147733 | 36037 | 36048 | TTCTTGATGTCC | 1-10-1 MOE | 891 |
| 147733 | 36071 | 36082 | TTCTTGATGTCC | 1-10-1 MOE | 891 |
| 147726 | 36126 | 36137 | TGACTCTCGGAC | 1-10-1 MOE | 1120 |
| 147736 | 36359 | 36370 | AGGTAGGAGAAG | 1-10-1 MOE | 963 |
| 147691 | 36360 | 36371 | GAGGTGGGAAAA | 1-10-1 MOE | 966 |
| 147736 | 36507 | 36518 | AGGTAGGAGAAG | 1-10-1 MOE | 963 |
| 147691 | 36508 | 36519 | GAGGTGGGAAAA | 1-10-1 MOE | 966 |
| 147746 | 36564 | 36575 | TAAAAACAACAA | 1-10-1 MOE | 1073 |
| 147723 | 36575 | 36586 | GACTCCAAAGTC | 1-10-1 MOE | 892 |
| 147731 | 36620 | 36631 | TTTCCTCTTGTC | 1-10-1 MOE | 934 |
| 147723 | 36723 | 36734 | GACTCCAAAGTC | 1-10-1 MOE | 892 |
| 147731 | 36768 | 36779 | TTTCCTCTTGTC | 1-10-1 MOE | 934 |
| 398169 | 37174 | 37185 | TCAGCCAGACAG | 1-10-1 MOE | 909 |
| 147688 | 37380 | 37391 | TCCCAAACAAAT | 1-10-1 MOE | 990 |
| 147688 | 37528 | 37539 | TCCCAAACAAAT | 1-10-1 MOE | 990 |
| 147714 | 37881 | 37892 | TTCTGCTCCCAC | 1-10-1 MOE | 986 |
| 147714 | 38029 | 38040 | TTCTGCTCCCAC | 1-10-1 MOE | 986 |
| 147681 | 38364 | 38375 | ATGTCATTAAAC | 1-10-1 MOE | 965 |
| 147736 | 38766 | 38777 | AGGTAGGAGAAG | 1-10-1 MOE | 963 |
| 147738 | 38909 | 38920 | TGGGTGGCCGGG | 1-10-1 MOE | 1069 |
| 147736 | 38914 | 38925 | AGGTAGGAGAAG | 1-10-1 MOE | 963 |
| 147738 | 39057 | 39068 | TGGGTGGCCGGG | 1-10-1 MOE | 1069 |
| 390030 | 39249 | 39260 | TTTATAAAACTG | 1-10-1 MOE | 1074 |
| 390030 | 39397 | 39408 | TTTATAAAACTG | 1-10-1 MOE | 1074 |
| 147717 | 39545 | 39556 | ATCTTCAGAGAT | 1-10-1 MOE | 996 |
| 147717 | 39693 | 39704 | ATCTTCAGAGAT | 1-10-1 MOE | 996 |
| 147746 | 39729 | 39740 | TAAAAACAACAA | 1-10-1 MOE | 1073 |
| 147746 | 39789 | 39800 | TAAAAACAACAA | 1-10-1 MOE | 1073 |
| 147691 | 39829 | 39840 | GAGGTGGGAAAA | 1-10-1 MOE | 966 |
| 147746 | 39877 | 39888 | TAAAAACAACAA | 1-10-1 MOE | 1073 |
| 147691 | 39977 | 39988 | GAGGTGGGAAAA | 1-10-1 MOE | 966 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147727 | 39983 | 39994 | CAGTGGACCACA | 1-10-1 MOE | 1128 |
| 147727 | 40131 | 40142 | CAGTGGACCACA | 1-10-1 MOE | 1128 |
| 147746 | 40333 | 40344 | TAAAACAACAA | 1-10-1 MOE | 1073 |
| 147719 | 40457 | 40468 | CCAACTCCAACT | 1-10-1 MOE | 1116 |
| 147679 | 40467 | 40478 | CAAAAGGATCCC | 1-10-1 MOE | 907 |
| 147746 | 40478 | 40489 | TAAAACAACAA | 1-10-1 MOE | 1073 |
| 147741 | 40565 | 40576 | CACCCACTGGTG | 1-10-1 MOE | 1055 |
| 398166 | 40589 | 40600 | GGGCTTCTTCCA | 1-10-1 MOE | 1070 |
| 147719 | 40605 | 40616 | CCAACTCCAACT | 1-10-1 MOE | 1116 |
| 147679 | 40615 | 40626 | CAAAAGGATCCC | 1-10-1 MOE | 907 |
| 147746 | 40626 | 40637 | TAAAACAACAA | 1-10-1 MOE | 1073 |
| 147735 | 40662 | 40673 | GGAGAAGCGCAG | 1-10-1 MOE | 1016 |
| 147746 | 40706 | 40717 | TAAAACAACAA | 1-10-1 MOE | 1073 |
| 147741 | 40713 | 40724 | CACCCACTGGTG | 1-10-1 MOE | 1055 |
| 398166 | 40737 | 40748 | GGGCTTCTTCCA | 1-10-1 MOE | 1070 |
| 147735 | 40810 | 40821 | GGAGAAGCGCAG | 1-10-1 MOE | 1016 |
| 147746 | 40854 | 40865 | TAAAACAACAA | 1-10-1 MOE | 1073 |
| 147718 | 41218 | 41229 | TAATATGACTTG | 1-10-1 MOE | 998 |
| 147717 | 41221 | 41232 | ATCTTCAGAGAT | 1-10-1 MOE | 996 |
| 147717 | 41369 | 41380 | ATCTTCAGAGAT | 1-10-1 MOE | 996 |
| 147723 | 41627 | 41638 | GACTCCAAAGTC | 1-10-1 MOE | 892 |
| 147717 | 41747 | 41758 | ATCTTCAGAGAT | 1-10-1 MOE | 996 |
| 147723 | 41775 | 41786 | GACTCCAAAGTC | 1-10-1 MOE | 892 |
| 390030 | 41908 | 41919 | TTTATAAAACTG | 1-10-1 MOE | 1074 |
| 390030 | 42056 | 42067 | TTTATAAAACTG | 1-10-1 MOE | 1074 |
| 398153 | 42157 | 42170 | ATTTCTCTTACAGG | 2-10-2 MOE | 948 |
| 398153 | 42305 | 42318 | ATTTCTCTTACAGG | 2-10-2 MOE | 948 |
| 147690 | 42423 | 42434 | TGAAGTTAATTC | 1-10-1 MOE | 1138 |
| 147695 | 42521 | 42532 | TCATTCCCCACT | 1-10-1 MOE | 984 |
| 147710 | 42543 | 42554 | TATAGCTCCTCT | 1-10-1 MOE | 994 |
| 147690 | 42571 | 42582 | TGAAGTTAATTC | 1-10-1 MOE | 1138 |
| 147695 | 42669 | 42680 | TCATTCCCCACT | 1-10-1 MOE | 984 |
| 147078 | 43321 | 43332 | CCTTCCACTGAT | 1-10-1 MOE | 1044 |
| 147079 | 43322 | 43333 | TCCTTCCACTGA | 1-10-1 MOE | 1001 |
| 147716 | 43329 | 43340 | TTAACGAGCCTT | 1-10-1 MOE | 949 |
| 147078 | 43469 | 43480 | CCTTCCACTGAT | 1-10-1 MOE | 1044 |
| 147079 | 43470 | 43481 | TCCTTCCACTGA | 1-10-1 MOE | 1001 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147080 | 43471 | 43482 | CTCCTTCCACTG | 1-10-1 MOE | 1021 |
| 398102 | 43837 | 43850 | CTACCTGAGGATTT | 2-10-2 MOE | 899 |
| 147074 | 43848 | 43859 | CCACTGATCCTG | 1-10-1 MOE | 845 |
| 401408 | 43871 | 43884 | CAATGAAGCACAGG | 2-10-2 MOE | 989 |
| 398102 | 43985 | 43998 | CTACCTGAGGATTT | 2-10-2 MOE | 899 |
| 147736 | 44137 | 44148 | AGGTAGGAGAAG | 1-10-1 MOE | 963 |
| 147746 | 44140 | 44151 | TAAAACAACAA | 1-10-1 MOE | 1073 |
| 147687 | 44206 | 44217 | CGACACGGGAAC | 1-10-1 MOE | 950 |
| 147743 | 44223 | 44234 | AGGGCTTCCAGT | 1-10-1 MOE | 1042 |
| 384545 | 44242 | 44253 | CAAGTAGGATGT | 1-10-1 MOE | 951 |
| 147736 | 44285 | 44296 | AGGTAGGAGAAG | 1-10-1 MOE | 963 |
| 147743 | 44371 | 44382 | AGGGCTTCCAGT | 1-10-1 MOE | 1042 |
| 384545 | 44390 | 44401 | CAAGTAGGATGT | 1-10-1 MOE | 951 |
| 147728 | 44589 | 44600 | GCCAGACAGAAG | 1-10-1 MOE | 1013 |
| 389948 | 44628 | 44639 | CCGTTGGACCCC | 1-10-1 MOE | 915 |
| 147720 | 44703 | 44714 | GATCTCTCGAGT | 1-10-1 MOE | 1117 |
| 147728 | 44729 | 44740 | GCCAGACAGAAG | 1-10-1 MOE | 1013 |
| 147728 | 44737 | 44748 | GCCAGACAGAAG | 1-10-1 MOE | 1013 |
| 389948 | 44776 | 44787 | CCGTTGGACCCC | 1-10-1 MOE | 915 |
| 147720 | 44851 | 44862 | GATCTCTCGAGT | 1-10-1 MOE | 1117 |
| 398110 | 44861 | 44874 | GTTCCCTTTGCAGG | 2-10-2 MOE | 952 |
| 147728 | 44877 | 44888 | GCCAGACAGAAG | 1-10-1 MOE | 1013 |
| 147705 | 45092 | 45103 | CGGTTTTTGTTC | 1-10-1 MOE | 1002 |
| 147705 | 45240 | 45251 | CGGTTTTTGTTC | 1-10-1 MOE | 1002 |
| 147681 | 45337 | 45348 | ATGTCATTAAAC | 1-10-1 MOE | 965 |
| 147681 | 45485 | 45496 | ATGTCATTAAAC | 1-10-1 MOE | 965 |
| 147096 | 45660 | 45671 | TTGTTGTTCCCT | 1-10-1 MOE | 1107 |
| 147096 | 45808 | 45819 | TTGTTGTTCCCT | 1-10-1 MOE | 1107 |
| 368368 | 45976 | 45989 | TCCACTGATCCTTA | 2-10-2 MOE | 1127 |
| 147074 | 45977 | 45988 | CCACTGATCCTG | 1-10-1 MOE | 845 |
| 147075 | 45978 | 45989 | TCCACTGATCCT | 1-10-1 MOE | 1026 |
| 147076 | 45979 | 45990 | TTCCACTGATCC | 1-10-1 MOE | 1029 |
| 368368 | 46124 | 46137 | TCCACTGATCCTTA | 2-10-2 MOE | 1127 |
| 147075 | 46126 | 46137 | TCCACTGATCCT | 1-10-1 MOE | 1026 |
| 147076 | 46127 | 46138 | TTCCACTGATCC | 1-10-1 MOE | 1029 |
| 147705 | 46555 | 46566 | CGGTTTTTGTTC | 1-10-1 MOE | 1002 |
| 147714 | 46685 | 46696 | TTCTGCTCCCAC | 1-10-1 MOE | 986 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147705 | 46703 | 46714 | CGGTTTTGTTC | 1-10-1 MOE | 1002 |
| 147714 | 46833 | 46844 | TTCTGCTCCCAC | 1-10-1 MOE | 986 |
| 390030 | 47007 | 47018 | TTTATAAAACTG | 1-10-1 MOE | 1074 |
| 147746 | 47023 | 47034 | TAAAAACAACAA | 1-10-1 MOE | 1073 |
| 147746 | 47171 | 47182 | TAAAAACAACAA | 1-10-1 MOE | 1073 |
| 147085 | 47607 | 47618 | TCTACACCAGGT | 1-10-1 MOE | 961 |
| 147746 | 47609 | 47620 | TAAAAACAACAA | 1-10-1 MOE | 1073 |
| 147089 | 47611 | 47622 | TCCCTCTACACC | 1-10-1 MOE | 956 |
| 147091 | 47613 | 47624 | GTTCCCTCTACA | 1-10-1 MOE | 1004 |
| 401384 | 47689 | 47702 | TGAACACATCACTA | 2-10-2 MOE | 933 |
| 147691 | 47729 | 47740 | GAGGTGGGAAAA | 1-10-1 MOE | 966 |
| 147085 | 47755 | 47766 | TCTACACCAGGT | 1-10-1 MOE | 961 |
| 147087 | 47757 | 47768 | CCTCTACACCAG | 1-10-1 MOE | 982 |
| 147090 | 47760 | 47771 | TTCCCTCTACAC | 1-10-1 MOE | 955 |
| 147091 | 47761 | 47772 | GTTCCCTCTACA | 1-10-1 MOE | 1004 |
| 147099 | 47770 | 47781 | GAGTTGTTGTTC | 1-10-1 MOE | 1108 |
| 147100 | 47771 | 47782 | CGAGTTGTTGTT | 1-10-1 MOE | 1109 |
| 390030 | 47847 | 47858 | TTTATAAAACTG | 1-10-1 MOE | 1074 |
| 147691 | 47877 | 47888 | GAGGTGGGAAAA | 1-10-1 MOE | 966 |
| 147099 | 47918 | 47929 | GAGTTGTTGTTC | 1-10-1 MOE | 1108 |
| 147100 | 47919 | 47930 | CGAGTTGTTGTT | 1-10-1 MOE | 1109 |
| 390030 | 47995 | 48006 | TTTATAAAACTG | 1-10-1 MOE | 1074 |
| 147074 | 48222 | 48233 | CCACTGATCCTG | 1-10-1 MOE | 845 |
| 147731 | 48340 | 48351 | TTTCCTCTTGTC | 1-10-1 MOE | 934 |
| 147691 | 48393 | 48404 | GAGGTGGGAAAA | 1-10-1 MOE | 966 |
| 147731 | 48488 | 48499 | TTTCCTCTTGTC | 1-10-1 MOE | 934 |
| 147691 | 48541 | 48552 | GAGGTGGGAAAA | 1-10-1 MOE | 966 |
| 398147 | 48887 | 48900 | CTACAGGACAATAC | 2-10-2 MOE | 957 |
| 398147 | 49035 | 49048 | CTACAGGACAATAC | 2-10-2 MOE | 957 |
| 147074 | 49525 | 49536 | CCACTGATCCTG | 1-10-1 MOE | 845 |
| 398168 | 49742 | 49753 | TCGGACTTTGAA | 1-10-1 MOE | 1008 |
| 384545 | 49858 | 49869 | CAAGTAGGATGT | 1-10-1 MOE | 951 |
| 398168 | 49890 | 49901 | TCGGACTTTGAA | 1-10-1 MOE | 1008 |
| 147724 | 49974 | 49985 | GAAATTGAGGAA | 1-10-1 MOE | 1139 |
| 384545 | 50006 | 50017 | CAAGTAGGATGT | 1-10-1 MOE | 951 |
| 147689 | 50084 | 50095 | CAGAGAAGGTCT | 1-10-1 MOE | 987 |
| 147687 | 50102 | 50113 | CGACACGGGAAC | 1-10-1 MOE | 950 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147724 | 50122 | 50133 | GAAATTGAGGAA | 1-10-1 MOE | 1139 |
| 147687 | 50250 | 50261 | CGACACGGGAAC | 1-10-1 MOE | 950 |
| 398117 | 50389 | 50402 | TTTCCACTTGGGTG | 2-10-2 MOE | 960 |
| 147736 | 50436 | 50447 | AGGTAGGAGAAG | 1-10-1 MOE | 963 |
| 147736 | 50582 | 50593 | AGGTAGGAGAAG | 1-10-1 MOE | 963 |
| 398168 | 50703 | 50714 | TCGGACTTTGAA | 1-10-1 MOE | 1008 |
| 401397 | 50822 | 50835 | CTGGTCAGCATTGA | 2-10-2 MOE | 946 |
| 147746 | 51019 | 51030 | TAAAACAACAA | 1-10-1 MOE | 1073 |
| 147708 | 51101 | 51112 | TTGATATAGTCA | 1-10-1 MOE | 997 |
| 147746 | 51165 | 51176 | TAAAACAACAA | 1-10-1 MOE | 1073 |
| 147746 | 51185 | 51196 | TAAAACAACAA | 1-10-1 MOE | 1073 |
| 147708 | 51247 | 51258 | TTGATATAGTCA | 1-10-1 MOE | 997 |
| 147081 | 51287 | 51298 | GCTCCTTCCACT | 1-10-1 MOE | 1006 |
| 147082 | 51288 | 51299 | AGCTCCTTCCAC | 1-10-1 MOE | 1036 |
| 147746 | 51324 | 51335 | TAAAACAACAA | 1-10-1 MOE | 1073 |
| 147746 | 51331 | 51342 | TAAAACAACAA | 1-10-1 MOE | 1073 |
| 147728 | 51376 | 51387 | GCCAGACAGAAG | 1-10-1 MOE | 1013 |
| 147729 | 51406 | 51417 | GTAAGAGGCAGG | 1-10-1 MOE | 920 |
| 147081 | 51433 | 51444 | GCTCCTTCCACT | 1-10-1 MOE | 1006 |
| 147082 | 51434 | 51445 | AGCTCCTTCCAC | 1-10-1 MOE | 1036 |
| 147728 | 51492 | 51503 | GCCAGACAGAAG | 1-10-1 MOE | 1013 |
| 147728 | 51522 | 51533 | GCCAGACAGAAG | 1-10-1 MOE | 1013 |
| 147729 | 51552 | 51563 | GTAAGAGGCAGG | 1-10-1 MOE | 920 |
| 368360 | 51633 | 51646 | AAGCTCCTTCCACT | 2-10-2 MOE | 1035 |
| 147082 | 51634 | 51645 | AGCTCCTTCCAC | 1-10-1 MOE | 1036 |
| 368361 | 51635 | 51648 | GAAAGCTCCTTCCA | 2-10-2 MOE | 962 |
| 147728 | 51638 | 51649 | GCCAGACAGAAG | 1-10-1 MOE | 1013 |
| 147695 | 51644 | 51655 | TCATTCCCCACT | 1-10-1 MOE | 984 |
| 147736 | 51713 | 51724 | AGGTAGGAGAAG | 1-10-1 MOE | 963 |
| 147684 | 51721 | 51732 | ACCCAGTCAGGG | 1-10-1 MOE | 964 |
| 147081 | 51779 | 51790 | GCTCCTTCCACT | 1-10-1 MOE | 1006 |
| 368360 | 51779 | 51792 | AAGCTCCTTCCACT | 2-10-2 MOE | 1035 |
| 147082 | 51780 | 51791 | AGCTCCTTCCAC | 1-10-1 MOE | 1036 |
| 368361 | 51781 | 51794 | GAAAGCTCCTTCCA | 2-10-2 MOE | 962 |
| 147695 | 51790 | 51801 | TCATTCCCCACT | 1-10-1 MOE | 984 |
| 147736 | 51859 | 51870 | AGGTAGGAGAAG | 1-10-1 MOE | 963 |
| 147077 | 51988 | 51999 | CTTCCACTGATC | 1-10-1 MOE | 1047 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147079 | 51990 | 52001 | TCCTTCCACTGA | 1-10-1 MOE | 1001 |
| 147746 | 52064 | 52075 | TAAAAACAACAA | 1-10-1 MOE | 1073 |
| 147681 | 52085 | 52096 | ATGTCATTAAAC | 1-10-1 MOE | 965 |
| 147077 | 52134 | 52145 | CTTCCACTGATC | 1-10-1 MOE | 1047 |
| 147079 | 52136 | 52147 | TCCTTCCACTGA | 1-10-1 MOE | 1001 |
| 147691 | 52166 | 52177 | GAGGTGGGAAAA | 1-10-1 MOE | 966 |
| 147719 | 52252 | 52263 | CCAACTCCAACT | 1-10-1 MOE | 1116 |
| 147691 | 52312 | 52323 | GAGGTGGGAAAA | 1-10-1 MOE | 966 |
| 147719 | 52398 | 52409 | CCAACTCCAACT | 1-10-1 MOE | 1116 |
| 147728 | 52428 | 52439 | GCCAGACAGAAG | 1-10-1 MOE | 1013 |
| 147729 | 52483 | 52494 | GTAAGAGGCAGG | 1-10-1 MOE | 920 |
| 398167 | 52527 | 52538 | CAGGCCATGTGG | 1-10-1 MOE | 1059 |
| 147682 | 52571 | 52582 | CGGGTACTATGG | 1-10-1 MOE | 992 |
| 147728 | 52574 | 52585 | GCCAGACAGAAG | 1-10-1 MOE | 1013 |
| 147724 | 52615 | 52626 | GAAATTGAGGAA | 1-10-1 MOE | 1139 |
| 147729 | 52629 | 52640 | GTAAGAGGCAGG | 1-10-1 MOE | 920 |
| 147703 | 52670 | 52681 | TGGCTTCATGTC | 1-10-1 MOE | 971 |
| 398167 | 52673 | 52684 | CAGGCCATGTGG | 1-10-1 MOE | 1059 |
| 398165 | 52708 | 52719 | GTTCTTAGGAAG | 1-10-1 MOE | 968 |
| 147704 | 52710 | 52721 | TTGTTCTTAGGA | 1-10-1 MOE | 1012 |
| 147705 | 52716 | 52727 | CGGTTTTGTTC | 1-10-1 MOE | 1002 |
| 147724 | 52761 | 52772 | GAAATTGAGGAA | 1-10-1 MOE | 1139 |
| 398167 | 52762 | 52773 | CAGGCCATGTGG | 1-10-1 MOE | 1059 |
| 147703 | 52816 | 52827 | TGGCTTCATGTC | 1-10-1 MOE | 971 |
| 398165 | 52854 | 52865 | GTTCTTAGGAAG | 1-10-1 MOE | 968 |
| 147704 | 52856 | 52867 | TTGTTCTTAGGA | 1-10-1 MOE | 1012 |
| 147705 | 52862 | 52873 | CGGTTTTGTTC | 1-10-1 MOE | 1002 |
| 398167 | 52908 | 52919 | CAGGCCATGTGG | 1-10-1 MOE | 1059 |
| 147689 | 53063 | 53074 | CAGAGAAGGTCT | 1-10-1 MOE | 987 |
| 147727 | 53111 | 53122 | CAGTGGACCACA | 1-10-1 MOE | 1128 |
| 147727 | 53158 | 53169 | CAGTGGACCACA | 1-10-1 MOE | 1128 |
| 147689 | 53209 | 53220 | CAGAGAAGGTCT | 1-10-1 MOE | 987 |
| 147727 | 53257 | 53268 | CAGTGGACCACA | 1-10-1 MOE | 1128 |
| 147727 | 53304 | 53315 | CAGTGGACCACA | 1-10-1 MOE | 1128 |
| 147680 | 53638 | 53649 | GTATGCACTGCT | 1-10-1 MOE | 988 |
| 147722 | 53650 | 53661 | AAAGTCAGGCCA | 1-10-1 MOE | 1130 |
| 147083 | 53703 | 53714 | TACACCAGGTCA | 1-10-1 MOE | 973 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147085 | 53705 | 53716 | TCTACACCAGGT | 1-10-1 MOE | 961 |
| 147086 | 53706 | 53717 | CTCTACACCAGG | 1-10-1 MOE | 969 |
| 398167 | 53724 | 53735 | CAGGCCATGTGG | 1-10-1 MOE | 1059 |
| 147684 | 53747 | 53758 | ACCCAGTCAGGG | 1-10-1 MOE | 964 |
| 147680 | 53784 | 53795 | GTATGCACTGCT | 1-10-1 MOE | 988 |
| 147722 | 53796 | 53807 | AAAGTCAGGCCA | 1-10-1 MOE | 1130 |
| 147085 | 53851 | 53862 | TCTACACCAGGT | 1-10-1 MOE | 961 |
| 398167 | 53870 | 53881 | CAGGCCATGTGG | 1-10-1 MOE | 1059 |
| 147684 | 53893 | 53904 | ACCCAGTCAGGG | 1-10-1 MOE | 964 |
| 398155 | 54026 | 54039 | TGTTTTTACACAGA | 2-10-2 MOE | 970 |
| 147703 | 54137 | 54148 | TGGCTTCATGTC | 1-10-1 MOE | 971 |
| 398155 | 54172 | 54185 | TGTTTTTACACAGA | 2-10-2 MOE | 970 |
| 147705 | 54275 | 54286 | CGGTTTTTGTTC | 1-10-1 MOE | 1002 |
| 147703 | 54283 | 54294 | TGGCTTCATGTC | 1-10-1 MOE | 971 |
| 147705 | 54421 | 54432 | CGGTTTTTGTTC | 1-10-1 MOE | 1002 |
| 147727 | 54853 | 54864 | CAGTGGACCACA | 1-10-1 MOE | 1128 |
| 398165 | 54963 | 54974 | GTTCTTAGGAAG | 1-10-1 MOE | 968 |
| 398090 | 54963 | 54976 | TTGTTCTTAGGAAG | 2-10-2 MOE | 972 |
| 147704 | 54965 | 54976 | TTGTTCTTAGGA | 1-10-1 MOE | 1012 |
| 147705 | 54971 | 54982 | CGGTTTTTGTTC | 1-10-1 MOE | 1002 |
| 147727 | 54999 | 55010 | CAGTGGACCACA | 1-10-1 MOE | 1128 |
| 398165 | 55109 | 55120 | GTTCTTAGGAAG | 1-10-1 MOE | 968 |
| 147704 | 55111 | 55122 | TTGTTCTTAGGA | 1-10-1 MOE | 1012 |
| 147705 | 55117 | 55128 | CGGTTTTTGTTC | 1-10-1 MOE | 1002 |
| 147083 | 55352 | 55363 | TACACCAGGTCA | 1-10-1 MOE | 973 |
| 147705 | 55378 | 55389 | CGGTTTTTGTTC | 1-10-1 MOE | 1002 |
| 147705 | 55524 | 55535 | CGGTTTTTGTTC | 1-10-1 MOE | 1002 |
| 147712 | 55819 | 55830 | ACACCATCTCCC | 1-10-1 MOE | 1005 |
| 147712 | 55965 | 55976 | ACACCATCTCCC | 1-10-1 MOE | 1005 |
| 147733 | 56289 | 56300 | TTCTTGATGTCC | 1-10-1 MOE | 891 |
| 147707 | 56300 | 56311 | TAGTCATTATCT | 1-10-1 MOE | 977 |
| 147708 | 56306 | 56317 | TTGATATAGTCA | 1-10-1 MOE | 997 |
| 390030 | 56321 | 56332 | TTTATAAAACTG | 1-10-1 MOE | 1074 |
| 147081 | 56333 | 56344 | GCTCCTTCCACT | 1-10-1 MOE | 1006 |
| 398166 | 56335 | 56346 | GGGCTTCTTCCA | 1-10-1 MOE | 1070 |
| 147733 | 56435 | 56446 | TTCTTGATGTCC | 1-10-1 MOE | 891 |
| 147707 | 56446 | 56457 | TAGTCATTATCT | 1-10-1 MOE | 977 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147708 | 56452 | 56463 | TTGATATAGTCA | 1-10-1 MOE | 997 |
| 390030 | 56467 | 56478 | TTTATAAAACTG | 1-10-1 MOE | 1074 |
| 147081 | 56479 | 56490 | GCTCCTTCCACT | 1-10-1 MOE | 1006 |
| 398091 | 56479 | 56492 | GGGCTTCTTCCATT | 2-10-2 MOE | 979 |
| 398166 | 56481 | 56492 | GGGCTTCTTCCA | 1-10-1 MOE | 1070 |
| 368366 | 56518 | 56531 | CTGATCCTTAGAAG | 2-10-2 MOE | 1019 |
| 147743 | 57612 | 57623 | AGGGCTTCCAGT | 1-10-1 MOE | 1042 |
| 147700 | 57709 | 57720 | GCGCTAGGCCGC | 1-10-1 MOE | 1110 |
| 147743 | 57758 | 57769 | AGGGCTTCCAGT | 1-10-1 MOE | 1042 |
| 147700 | 57855 | 57866 | GCGCTAGGCCGC | 1-10-1 MOE | 1110 |
| 398093 | 57963 | 57976 | TCGGACTTTGAAAA | 2-10-2 MOE | 1009 |
| 398168 | 57965 | 57976 | TCGGACTTTGAA | 1-10-1 MOE | 1008 |
| 147698 | 58105 | 58116 | CCCGCCACCACC | 1-10-1 MOE | 928 |
| 398093 | 58109 | 58122 | TCGGACTTTGAAAA | 2-10-2 MOE | 1009 |
| 398168 | 58111 | 58122 | TCGGACTTTGAA | 1-10-1 MOE | 1008 |
| 147698 | 58251 | 58262 | CCCGCCACCACC | 1-10-1 MOE | 928 |
| 147735 | 58279 | 58290 | GGAGAAGCGCAG | 1-10-1 MOE | 1016 |
| 147735 | 58425 | 58436 | GGAGAAGCGCAG | 1-10-1 MOE | 1016 |
| 404135 | 58946 | 58959 | CATTTCCATGGCCA | 2-10-2 MOE | 1056 |
| 390030 | 59326 | 59337 | TTTATAAAACTG | 1-10-1 MOE | 1074 |
| 147711 | 59357 | 59368 | AAGGGCCCTGGG | 1-10-1 MOE | 1040 |
| 147743 | 59382 | 59393 | AGGGCTTCCAGT | 1-10-1 MOE | 1042 |
| 147711 | 59503 | 59514 | AAGGGCCCTGGG | 1-10-1 MOE | 1040 |
| 147743 | 59528 | 59539 | AGGGCTTCCAGT | 1-10-1 MOE | 1042 |
| 147695 | 59576 | 59587 | TCATTCCCCACT | 1-10-1 MOE | 984 |
| 147713 | 59716 | 59727 | CTCCCACACCAT | 1-10-1 MOE | 985 |
| 147714 | 59721 | 59732 | TTCTGCTCCCAC | 1-10-1 MOE | 986 |
| 147715 | 59746 | 59757 | GTTGAGCATGAC | 1-10-1 MOE | 1077 |
| 147716 | 59771 | 59782 | TTAACGAGCCTT | 1-10-1 MOE | 949 |
| 147712 | 59857 | 59868 | ACACCATCTCCC | 1-10-1 MOE | 1005 |
| 147714 | 59867 | 59878 | TTCTGCTCCCAC | 1-10-1 MOE | 986 |
| 147715 | 59892 | 59903 | GTTGAGCATGAC | 1-10-1 MOE | 1077 |
| 147716 | 59917 | 59928 | TTAACGAGCCTT | 1-10-1 MOE | 949 |
| 390030 | 59993 | 60004 | TTTATAAAACTG | 1-10-1 MOE | 1074 |
| 147690 | 60270 | 60281 | TGAAGTTAATTC | 1-10-1 MOE | 1138 |
| 389949 | 60325 | 60336 | GCGCGAGCCCGA | 1-10-1 MOE | 1061 |
| 147690 | 60416 | 60427 | TGAAGTTAATTC | 1-10-1 MOE | 1138 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 389949 | 60471 | 60482 | GCGCGAGCCCGA | 1-10-1 MOE | 1061 |
| 147746 | 60619 | 60630 | TAAAAACAACAA | 1-10-1 MOE | 1073 |
| 384545 | 60676 | 60687 | CAAGTAGGATGT | 1-10-1 MOE | 951 |
| 147746 | 60765 | 60776 | TAAAAACAACAA | 1-10-1 MOE | 1073 |
| 384545 | 60822 | 60833 | CAAGTAGGATGT | 1-10-1 MOE | 951 |
| 147689 | 60967 | 60978 | CAGAGAAGGTCT | 1-10-1 MOE | 987 |
| 147689 | 61008 | 61019 | CAGAGAAGGTCT | 1-10-1 MOE | 987 |
| 147689 | 61049 | 61060 | CAGAGAAGGTCT | 1-10-1 MOE | 987 |
| 398105 | 61121 | 61134 | TGCACAGGCAGGTT | 2-10-2 MOE | 1066 |
| 147689 | 61154 | 61165 | CAGAGAAGGTCT | 1-10-1 MOE | 987 |
| 147689 | 61195 | 61206 | CAGAGAAGGTCT | 1-10-1 MOE | 987 |
| 398105 | 61267 | 61280 | TGCACAGGCAGGTT | 2-10-2 MOE | 1066 |
| 147692 | 61365 | 61376 | CTCACCTTCATG | 1-10-1 MOE | 1113 |
| 147692 | 61511 | 61522 | CTCACCTTCATG | 1-10-1 MOE | 1113 |
| 147680 | 61619 | 61630 | GTATGCACTGCT | 1-10-1 MOE | 988 |
| 147078 | 61755 | 61766 | CCTTCCACTGAT | 1-10-1 MOE | 1044 |
| 147079 | 61756 | 61767 | TCCTTCCACTGA | 1-10-1 MOE | 1001 |
| 147080 | 61757 | 61768 | CTCCTTCCACTG | 1-10-1 MOE | 1021 |
| 147078 | 61901 | 61912 | CCTTCCACTGAT | 1-10-1 MOE | 1044 |
| 147079 | 61902 | 61913 | TCCTTCCACTGA | 1-10-1 MOE | 1001 |
| 147080 | 61903 | 61914 | CTCCTTCCACTG | 1-10-1 MOE | 1021 |
| 147088 | 62361 | 62372 | CCCTCTACACCA | 1-10-1 MOE | 1050 |
| 401384 | 62573 | 62586 | TGAACACATCACTA | 2-10-2 MOE | 933 |
| 147688 | 62697 | 62708 | TCCCAAACAAAT | 1-10-1 MOE | 990 |
| 147746 | 63102 | 63113 | TAAAAACAACAA | 1-10-1 MOE | 1073 |
| 147721 | 63225 | 63236 | AATGCAGGATCT | 1-10-1 MOE | 1118 |
| 147742 | 63226 | 63237 | AACTTCAGTGTC | 1-10-1 MOE | 1041 |
| 147746 | 63248 | 63259 | TAAAAACAACAA | 1-10-1 MOE | 1073 |
| 147682 | 63337 | 63348 | CGGGTACTATGG | 1-10-1 MOE | 992 |
| 147721 | 63371 | 63382 | AATGCAGGATCT | 1-10-1 MOE | 1118 |
| 147742 | 63372 | 63383 | AACTTCAGTGTC | 1-10-1 MOE | 1041 |
| 147688 | 63401 | 63412 | TCCCAAACAAAT | 1-10-1 MOE | 990 |
| 147097 | 63449 | 63460 | GTTGTTGTTCCC | 1-10-1 MOE | 1111 |
| 147098 | 63450 | 63461 | AGTTGTTGTTCC | 1-10-1 MOE | 1112 |
| 401409 | 63458 | 63471 | ATTCTTAACACAGA | 2-10-2 MOE | 991 |
| 147084 | 63531 | 63542 | CTACACCAGGTC | 1-10-1 MOE | 993 |
| 147688 | 63547 | 63558 | TCCCAAACAAAT | 1-10-1 MOE | 990 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147097 | 63595 | 63606 | GTTGTTGTTCCC | 1-10-1 MOE | 1111 |
| 147098 | 63596 | 63607 | AGTTGTTGTTCC | 1-10-1 MOE | 1112 |
| 147721 | 64086 | 64097 | AATGCAGGATCT | 1-10-1 MOE | 1118 |
| 147721 | 64232 | 64243 | AATGCAGGATCT | 1-10-1 MOE | 1118 |
| 147692 | 64233 | 64244 | CTCACCTTCATG | 1-10-1 MOE | 1113 |
| 147692 | 64379 | 64390 | CTCACCTTCATG | 1-10-1 MOE | 1113 |
| 147729 | 64633 | 64644 | GTAAGAGGCAGG | 1-10-1 MOE | 920 |
| 401403 | 64746 | 64759 | TTTCCTAGGAGGTG | 2-10-2 MOE | 967 |
| 147729 | 64779 | 64790 | GTAAGAGGCAGG | 1-10-1 MOE | 920 |
| 147746 | 65151 | 65162 | TAAAAACAACAA | 1-10-1 MOE | 1073 |
| 147746 | 65297 | 65308 | TAAAAACAACAA | 1-10-1 MOE | 1073 |
| 147689 | 65302 | 65313 | CAGAGAAGGTCT | 1-10-1 MOE | 987 |
| 147689 | 65448 | 65459 | CAGAGAAGGTCT | 1-10-1 MOE | 987 |
| 147717 | 65862 | 65873 | ATCTTCAGAGAT | 1-10-1 MOE | 996 |
| 147717 | 65895 | 65906 | ATCTTCAGAGAT | 1-10-1 MOE | 996 |
| 147729 | 66000 | 66011 | GTAAGAGGCAGG | 1-10-1 MOE | 920 |
| 147717 | 66008 | 66019 | ATCTTCAGAGAT | 1-10-1 MOE | 996 |
| 147717 | 66041 | 66052 | ATCTTCAGAGAT | 1-10-1 MOE | 996 |
| 147708 | 66046 | 66057 | TTGATATAGTCA | 1-10-1 MOE | 997 |
| 147718 | 66055 | 66066 | TAATATGACTTG | 1-10-1 MOE | 998 |
| 147729 | 66146 | 66157 | GTAAGAGGCAGG | 1-10-1 MOE | 920 |
| 147089 | 66236 | 66247 | TCCCTCTACACC | 1-10-1 MOE | 956 |
| 368363 | 66281 | 66294 | CTTAGAAGGCAGCA | 2-10-2 MOE | 1114 |
| 147727 | 66293 | 66304 | CAGTGGACCACA | 1-10-1 MOE | 1128 |
| 147093 | 66319 | 66330 | TTGTTCCCTCTA | 1-10-1 MOE | 929 |
| 147094 | 66320 | 66331 | GTTGTTCCCTCT | 1-10-1 MOE | 1115 |
| 147089 | 66382 | 66393 | TCCCTCTACACC | 1-10-1 MOE | 956 |
| 368363 | 66427 | 66440 | CTTAGAAGGCAGCA | 2-10-2 MOE | 1114 |
| 147727 | 66439 | 66450 | CAGTGGACCACA | 1-10-1 MOE | 1128 |
| 147719 | 66441 | 66452 | CCAACTCCAACT | 1-10-1 MOE | 1116 |
| 147093 | 66465 | 66476 | TTGTTCCCTCTA | 1-10-1 MOE | 929 |
| 147094 | 66466 | 66477 | GTTGTTCCCTCT | 1-10-1 MOE | 1115 |
| 147075 | 66561 | 66572 | TCCACTGATCCT | 1-10-1 MOE | 1026 |
| 368357 | 66562 | 66575 | CCTTCCACTGATCC | 2-10-2 MOE | 1046 |
| 147076 | 66562 | 66573 | TTCCACTGATCC | 1-10-1 MOE | 1029 |
| 368377 | 66562 | 66577 | CTCCTTCCACTGATCC | 3-10-3 MOE | 1030 |
| 147077 | 66563 | 66574 | CTTCCACTGATC | 1-10-1 MOE | 1047 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 368358 | 66563 | 66576 | TCCTTCCACTGATC | 2-10-2 MOE | 1031 |
| 147078 | 66564 | 66575 | CCTTCCACTGAT | 1-10-1 MOE | 1044 |
| 147079 | 66565 | 66576 | TCCTTCCACTGA | 1-10-1 MOE | 1001 |
| 147080 | 66566 | 66577 | CTCCTTCCACTG | 1-10-1 MOE | 1021 |
| 147081 | 66567 | 66578 | GCTCCTTCCACT | 1-10-1 MOE | 1006 |
| 147719 | 66587 | 66598 | CCAACTCCAACT | 1-10-1 MOE | 1116 |
| 147075 | 66707 | 66718 | TCCACTGATCCT | 1-10-1 MOE | 1026 |
| 368377 | 66708 | 66723 | CTCCTTCCACTGATCC | 3-10-3 MOE | 1030 |
| 147076 | 66708 | 66719 | TTCCACTGATCC | 1-10-1 MOE | 1029 |
| 368357 | 66708 | 66721 | CCTTCCACTGATCC | 2-10-2 MOE | 1046 |
| 147077 | 66709 | 66720 | CTTCCACTGATC | 1-10-1 MOE | 1047 |
| 147078 | 66710 | 66721 | CCTTCCACTGAT | 1-10-1 MOE | 1044 |
| 147079 | 66711 | 66722 | TCCTTCCACTGA | 1-10-1 MOE | 1001 |
| 147080 | 66712 | 66723 | CTCCTTCCACTG | 1-10-1 MOE | 1021 |
| 147081 | 66713 | 66724 | GCTCCTTCCACT | 1-10-1 MOE | 1006 |
| 147089 | 66842 | 66853 | TCCCTCTACACC | 1-10-1 MOE | 956 |
| 147089 | 66988 | 66999 | TCCCTCTACACC | 1-10-1 MOE | 956 |
| 147075 | 66999 | 67010 | TCCACTGATCCT | 1-10-1 MOE | 1026 |
| 147075 | 67145 | 67156 | TCCACTGATCCT | 1-10-1 MOE | 1026 |
| 147705 | 67213 | 67224 | CGGTTTTGTTC | 1-10-1 MOE | 1002 |
| 401413 | 67301 | 67314 | TGCAGCCATGTACT | 2-10-2 MOE | 1022 |
| 147737 | 67309 | 67320 | ACAGCCAGGTAG | 1-10-1 MOE | 1067 |
| 147080 | 67430 | 67441 | CTCCTTCCACTG | 1-10-1 MOE | 1021 |
| 147737 | 67455 | 67466 | ACAGCCAGGTAG | 1-10-1 MOE | 1067 |
| 147080 | 67576 | 67587 | CTCCTTCCACTG | 1-10-1 MOE | 1021 |
| 147082 | 67578 | 67589 | AGCTCCTTCCAC | 1-10-1 MOE | 1036 |
| 147090 | 67582 | 67593 | TTCCCTCTACAC | 1-10-1 MOE | 955 |
| 147091 | 67583 | 67594 | GTTCCCTCTACA | 1-10-1 MOE | 1004 |
| 147742 | 67591 | 67602 | AACTTCAGTGTC | 1-10-1 MOE | 1041 |
| 147090 | 67728 | 67739 | TTCCCTCTACAC | 1-10-1 MOE | 955 |
| 147698 | 68036 | 68047 | CCCGCCACCACC | 1-10-1 MOE | 928 |
| 147698 | 68182 | 68193 | CCCGCCACCACC | 1-10-1 MOE | 928 |
| 147681 | 68267 | 68278 | ATGTCATTAAAC | 1-10-1 MOE | 965 |
| 147721 | 68386 | 68397 | AATGCAGGATCT | 1-10-1 MOE | 1118 |
| 147681 | 68413 | 68424 | ATGTCATTAAAC | 1-10-1 MOE | 965 |
| 147712 | 68527 | 68538 | ACACCATCTCCC | 1-10-1 MOE | 1005 |
| 147721 | 68532 | 68543 | AATGCAGGATCT | 1-10-1 MOE | 1118 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147711 | 68760 | 68771 | AAGGGCCCTGGG | 1-10-1 MOE | 1040 |
| 147711 | 68906 | 68917 | AAGGGCCCTGGG | 1-10-1 MOE | 1040 |
| 147696 | 69045 | 69056 | TGGATGATTGGC | 1-10-1 MOE | 906 |
| 147696 | 69191 | 69202 | TGGATGATTGGC | 1-10-1 MOE | 906 |
| 147723 | 69194 | 69205 | GACTCCAAAGTC | 1-10-1 MOE | 892 |
| 147723 | 69210 | 69221 | GACTCCAAAGTC | 1-10-1 MOE | 892 |
| 389965 | 69271 | 69282 | CTGCAACATGAT | 1-10-1 MOE | 1018 |
| 389764 | 69271 | 69282 | CTGCAACATGAT | 1-9-2 MOE | 1018 |
| 147723 | 69340 | 69351 | GACTCCAAAGTC | 1-10-1 MOE | 892 |
| 147723 | 69356 | 69367 | GACTCCAAAGTC | 1-10-1 MOE | 892 |
| 398101 | 69357 | 69370 | TTTGATAAAGCCCT | 2-10-2 MOE | 1064 |
| 389965 | 69417 | 69428 | CTGCAACATGAT | 1-10-1 MOE | 1018 |
| 389764 | 69417 | 69428 | CTGCAACATGAT | 1-9-2 MOE | 1018 |
| 398101 | 69503 | 69516 | TTTGATAAAGCCCT | 2-10-2 MOE | 1064 |
| 368353 | 69519 | 69532 | CACTGATCCTGCAC | 2-10-2 MOE | 1007 |
| 147074 | 69522 | 69533 | CCACTGATCCTG | 1-10-1 MOE | 845 |
| 147081 | 69631 | 69642 | GCTCCTTCCACT | 1-10-1 MOE | 1006 |
| 368353 | 69665 | 69678 | CACTGATCCTGCAC | 2-10-2 MOE | 1007 |
| 147720 | 69729 | 69740 | GATCTCTCGAGT | 1-10-1 MOE | 1117 |
| 147721 | 69736 | 69747 | AATGCAGGATCT | 1-10-1 MOE | 1118 |
| 398167 | 69757 | 69768 | CAGGCCATGTGG | 1-10-1 MOE | 1059 |
| 147722 | 69762 | 69773 | AAAGTCAGGCCA | 1-10-1 MOE | 1130 |
| 147723 | 69768 | 69779 | GACTCCAAAGTC | 1-10-1 MOE | 892 |
| 147080 | 69776 | 69787 | CTCCTTCCACTG | 1-10-1 MOE | 1021 |
| 147081 | 69777 | 69788 | GCTCCTTCCACT | 1-10-1 MOE | 1006 |
| 398093 | 69811 | 69824 | TCGGACTTTGAAAA | 2-10-2 MOE | 1009 |
| 398168 | 69813 | 69824 | TCGGACTTTGAA | 1-10-1 MOE | 1008 |
| 147725 | 69814 | 69825 | CTCGGACTTTGA | 1-10-1 MOE | 1119 |
| 147726 | 69819 | 69830 | TGACTCTCGGAC | 1-10-1 MOE | 1120 |
| 147727 | 69860 | 69871 | CAGTGGACCACA | 1-10-1 MOE | 1128 |
| 147720 | 69875 | 69886 | GATCTCTCGAGT | 1-10-1 MOE | 1117 |
| 147721 | 69882 | 69893 | AATGCAGGATCT | 1-10-1 MOE | 1118 |
| 147728 | 69899 | 69910 | GCCAGACAGAAG | 1-10-1 MOE | 1013 |
| 398094 | 69901 | 69914 | ATCAGCCAGACAGA | 2-10-2 MOE | 1010 |
| 398167 | 69903 | 69914 | CAGGCCATGTGG | 1-10-1 MOE | 1059 |
| 398092 | 69904 | 69917 | AGTCAGGCCATGTG | 2-10-2 MOE | 1060 |
| 147722 | 69908 | 69919 | AAAGTCAGGCCA | 1-10-1 MOE | 1130 |

TABLE 19-continued

Short antisense compounds targeted to SEQ ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147723 | 69914 | 69925 | GACTCCAAAGTC | 1-10-1 MOE | 892 |
| 147729 | 69916 | 69927 | GTAAGAGGCAGG | 1-10-1 MOE | 920 |
| 398095 | 69919 | 69932 | CATCAGCAAGAGGC | 2-10-2 MOE | 1011 |
| 398093 | 69957 | 69970 | TCGGACTTTGAAAA | 2-10-2 MOE | 1009 |
| 398168 | 69959 | 69970 | TCGGACTTTGAA | 1-10-1 MOE | 1008 |
| 147725 | 69960 | 69971 | CTCGGACTTTGA | 1-10-1 MOE | 1119 |
| 147726 | 69965 | 69976 | TGACTCTCGGAC | 1-10-1 MOE | 1120 |
| 147704 | 69991 | 70002 | TTGTTCTTAGGA | 1-10-1 MOE | 1012 |
| 147727 | 70006 | 70017 | CAGTGGACCACA | 1-10-1 MOE | 1128 |
| 147728 | 70045 | 70056 | GCCAGACAGAAG | 1-10-1 MOE | 1013 |
| 398094 | 70047 | 70060 | ATCAGCCAGACAGA | 2-10-2 MOE | 1010 |
| 398169 | 70048 | 70059 | TCAGCCAGACAG | 1-10-1 MOE | 909 |
| 147729 | 70062 | 70073 | GTAAGAGGCAGG | 1-10-1 MOE | 920 |
| 398095 | 70065 | 70078 | CATCAGCAAGAGGC | 2-10-2 MOE | 1011 |
| 147704 | 70137 | 70148 | TTGTTCTTAGGA | 1-10-1 MOE | 1012 |
| 147697 | 70161 | 70172 | CCCCAGCAGCGG | 1-10-1 MOE | 1000 |
| 147697 | 70307 | 70318 | CCCCAGCAGCGG | 1-10-1 MOE | 1000 |
| 147728 | 70450 | 70461 | GCCAGACAGAAG | 1-10-1 MOE | 1013 |
| 398164 | 70464 | 70475 | TTGTCGATCTGC | 1-10-1 MOE | 1014 |
| 147730 | 70465 | 70476 | CTTGTCCATCAG | 1-10-1 MOE | 1121 |
| 147731 | 70471 | 70482 | TTTCCTCTTGTC | 1-10-1 MOE | 934 |
| 147732 | 70476 | 70487 | GGGTCTTTCCTC | 1-10-1 MOE | 1122 |
| 147733 | 70497 | 70508 | TTCTTGATGTCC | 1-10-1 MOE | 891 |
| 398096 | 70562 | 70575 | GGAGAAGCGCAGCT | 2-10-2 MOE | 1015 |
| 147735 | 70564 | 70575 | GGAGAAGCGCAG | 1-10-1 MOE | 1016 |
| 147736 | 70569 | 70580 | AGGTAGGAGAAG | 1-10-1 MOE | 963 |
| 147737 | 70575 | 70586 | ACAGCCAGGTAG | 1-10-1 MOE | 1067 |
| 147728 | 70596 | 70607 | GCCAGACAGAAG | 1-10-1 MOE | 1013 |
| 398164 | 70610 | 70621 | TTGTCGATCTGC | 1-10-1 MOE | 1014 |
| 147730 | 70611 | 70622 | CTTGTCCATCAG | 1-10-1 MOE | 1121 |
| 368349 | 70616 | 70629 | CTGCACTGACGAGT | 2-10-2 MOE | 1017 |
| 147731 | 70617 | 70628 | TTTCCTCTTGTC | 1-10-1 MOE | 934 |
| 147732 | 70622 | 70633 | GGGTCTTTCCTC | 1-10-1 MOE | 1122 |
| 147733 | 70643 | 70654 | TTCTTGATGTCC | 1-10-1 MOE | 891 |
| 398096 | 70708 | 70721 | GGAGAAGCGCAGCT | 2-10-2 MOE | 1015 |
| 147735 | 70710 | 70721 | GGAGAAGCGCAG | 1-10-1 MOE | 1016 |
| 147736 | 70715 | 70726 | AGGTAGGAGAAG | 1-10-1 MOE | 963 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147737 | 70721 | 70732 | ACAGCCAGGTAG | 1-10-1 MOE | 1067 |
| 389764 | 70784 | 70795 | CTGCAACATGAT | 1-9-2 MOE | 1018 |
| 389965 | 70784 | 70795 | CTGCAACATGAT | 1-10-1 MOE | 1018 |
| 389965 | 70930 | 70941 | CTGCAACATGAT | 1-10-1 MOE | 1018 |
| 389764 | 70930 | 70941 | CTGCAACATGAT | 1-9-2 MOE | 1018 |
| 368386 | 70995 | 71010 | CACTGATCCTTAGAAG | 3-10-3 MOE | 1123 |
| 368367 | 70997 | 71010 | CACTGATCCTTAGA | 2-10-2 MOE | 1124 |
| 368387 | 70997 | 71012 | TCCACTGATCCTTAGA | 3-10-3 MOE | 1125 |
| 368354 | 70999 | 71012 | TCCACTGATCCTGC | 2-10-2 MOE | 1024 |
| 368374 | 70999 | 71014 | CTTCCACTGATCCTGC | 3-10-3 MOE | 1126 |
| 368368 | 70999 | 71012 | TCCACTGATCCTTA | 2-10-2 MOE | 1127 |
| 368388 | 70999 | 71014 | CTTCCACTGATCCTTA | 3-10-3 MOE | 895 |
| 368355 | 71000 | 71013 | TTCCACTGATCCTG | 2-10-2 MOE | 1025 |
| 147074 | 71000 | 71011 | CCACTGATCCTG | 1-10-1 MOE | 845 |
| 368375 | 71000 | 71015 | CCTTCCACTGATCCTG | 3-10-3 MOE | 1020 |
| 147075 | 71001 | 71012 | TCCACTGATCCT | 1-10-1 MOE | 1026 |
| 368376 | 71001 | 71016 | TCCTTCCACTGATCCT | 3-10-3 MOE | 1028 |
| 147076 | 71002 | 71013 | TTCCACTGATCC | 1-10-1 MOE | 1029 |
| 368357 | 71002 | 71015 | CCTTCCACTGATCC | 2-10-2 MOE | 1046 |
| 368377 | 71002 | 71017 | CTCCTTCCACTGATCC | 3-10-3 MOE | 1030 |
| 147077 | 71003 | 71014 | CTTCCACTGATC | 1-10-1 MOE | 1047 |
| 368378 | 71003 | 71018 | GCTCCTTCCACTGATC | 3-10-3 MOE | 1032 |
| 147078 | 71004 | 71015 | CCTTCCACTGAT | 1-10-1 MOE | 1044 |
| 368359 | 71005 | 71018 | GCTCCTTCCACTGA | 2-10-2 MOE | 1033 |
| 368379 | 71005 | 71020 | AAGCTCCTTCCACTGA | 3-10-3 MOE | 1034 |
| 147079 | 71005 | 71016 | TCCTTCCACTGA | 1-10-1 MOE | 1001 |
| 147080 | 71006 | 71017 | CTCCTTCCACTG | 1-10-1 MOE | 1021 |
| 368360 | 71007 | 71020 | AAGCTCCTTCCACT | 2-10-2 MOE | 1035 |
| 368380 | 71007 | 71022 | GAAAGCTCCTTCCACT | 3-10-3 MOE | 896 |
| 147081 | 71007 | 71018 | GCTCCTTCCACT | 1-10-1 MOE | 1006 |
| 147082 | 71008 | 71019 | AGCTCCTTCCAC | 1-10-1 MOE | 1036 |
| 368361 | 71009 | 71022 | GAAAGCTCCTTCCA | 2-10-2 MOE | 962 |
| 368381 | 71009 | 71024 | GGGAAAGCTCCTTCCA | 3-10-3 MOE | 1037 |
| 147738 | 71067 | 71078 | TGGGTGGCCGGG | 1-10-1 MOE | 1069 |
| 147739 | 71071 | 71082 | CGTTTGGGTGGC | 1-10-1 MOE | 1023 |
| 147740 | 71088 | 71099 | TGTGAGGCTCCA | 1-10-1 MOE | 1062 |
| 147741 | 71129 | 71140 | CACCCACTGGTG | 1-10-1 MOE | 1055 |

TABLE 19-continued

Short antisense compounds targeted to SEQ ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 368366 | 71141 | 71154 | CTGATCCTTAGAAG | 2-10-2 MOE | 1019 |
| 368386 | 71141 | 71156 | CACTGATCCTTAGAAG | 3-10-3 MOE | 1123 |
| 368367 | 71143 | 71156 | CACTGATCCTTAGA | 2-10-2 MOE | 1124 |
| 368387 | 71143 | 71158 | TCCACTGATCCTTAGA | 3-10-3 MOE | 1125 |
| 368374 | 71145 | 71160 | CTTCCACTGATCCTGC | 3-10-3 MOE | 1126 |
| 368354 | 71145 | 71158 | TCCACTGATCCTGC | 2-10-2 MOE | 1024 |
| 368368 | 71145 | 71158 | TCCACTGATCCTTA | 2-10-2 MOE | 1127 |
| 368388 | 71145 | 71160 | CTTCCACTGATCCTTA | 3-10-3 MOE | 895 |
| 368355 | 71146 | 71159 | TTCCACTGATCCTG | 2-10-2 MOE | 1025 |
| 368375 | 71146 | 71161 | CCTTCCACTGATCCTG | 3-10-3 MOE | 1020 |
| 147075 | 71147 | 71158 | TCCACTGATCCT | 1-10-1 MOE | 1026 |
| 368356 | 71147 | 71160 | CTTCCACTGATCCT | 2-10-2 MOE | 1027 |
| 368376 | 71147 | 71162 | TCCTTCCACTGATCCT | 3-10-3 MOE | 1028 |
| 147076 | 71148 | 71159 | TTCCACTGATCC | 1-10-1 MOE | 1029 |
| 368357 | 71148 | 71161 | CCTTCCACTGATCC | 2-10-2 MOE | 1046 |
| 368377 | 71148 | 71163 | CTCCTTCCACTGATCC | 3-10-3 MOE | 1030 |
| 147077 | 71149 | 71160 | CTTCCACTGATC | 1-10-1 MOE | 1047 |
| 368358 | 71149 | 71162 | TCCTTCCACTGATC | 2-10-2 MOE | 1031 |
| 368378 | 71149 | 71164 | GCTCCTTCCACTGATC | 3-10-3 MOE | 1032 |
| 147078 | 71150 | 71161 | CCTTCCACTGAT | 1-10-1 MOE | 1044 |
| 368359 | 71151 | 71164 | GCTCCTTCCACTGA | 2-10-2 MOE | 1033 |
| 147079 | 71151 | 71162 | TCCTTCCACTGA | 1-10-1 MOE | 1001 |
| 368379 | 71151 | 71166 | AAGCTCCTTCCACTGA | 3-10-3 MOE | 1034 |
| 147080 | 71152 | 71163 | CTCCTTCCACTG | 1-10-1 MOE | 1021 |
| 368380 | 71153 | 71168 | GAAAGCTCCTTCCACT | 3-10-3 MOE | 896 |
| 147081 | 71153 | 71164 | GCTCCTTCCACT | 1-10-1 MOE | 1006 |
| 368360 | 71153 | 71166 | AAGCTCCTTCCACT | 2-10-2 MOE | 1035 |
| 147082 | 71154 | 71165 | AGCTCCTTCCAC | 1-10-1 MOE | 1036 |
| 368381 | 71155 | 71170 | GGGAAAGCTCCTTCCA | 3-10-3 MOE | 1037 |
| 368361 | 71155 | 71168 | GAAAGCTCCTTCCA | 2-10-2 MOE | 962 |
| 398097 | 71158 | 71171 | GGCAGTCTTTATCC | 2-10-2 MOE | 897 |
| 147738 | 71213 | 71224 | TGGGTGGCCGGG | 1-10-1 MOE | 1069 |
| 147739 | 71217 | 71228 | CGTTTGGGTGGC | 1-10-1 MOE | 1023 |
| 147740 | 71234 | 71245 | TGTGAGGCTCCA | 1-10-1 MOE | 1062 |
| 147741 | 71275 | 71286 | CACCCACTGGTG | 1-10-1 MOE | 1055 |
| 398097 | 71304 | 71317 | GGCAGTCTTTATCC | 2-10-2 MOE | 897 |
| 147727 | 71702 | 71713 | CAGTGGACCACA | 1-10-1 MOE | 1128 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147727 | 71848 | 71859 | CAGTGGACCACA | 1-10-1 MOE | 1128 |
| 390030 | 71986 | 71997 | TTTATAAAACTG | 1-10-1 MOE | 1074 |
| 147102 | 72015 | 72026 | TGCGAGTTGTTG | 1-10-1 MOE | 1129 |
| 390030 | 72132 | 72143 | TTTATAAAACTG | 1-10-1 MOE | 1074 |
| 147102 | 72161 | 72172 | TGCGAGTTGTTG | 1-10-1 MOE | 1129 |
| 147722 | 72199 | 72210 | AAAGTCAGGCCA | 1-10-1 MOE | 1130 |
| 147696 | 72232 | 72243 | TGGATGATTGGC | 1-10-1 MOE | 906 |
| 147741 | 72254 | 72265 | CACCCACTGGTG | 1-10-1 MOE | 1055 |
| 147722 | 72345 | 72356 | AAAGTCAGGCCA | 1-10-1 MOE | 1130 |
| 147696 | 72378 | 72389 | TGGATGATTGGC | 1-10-1 MOE | 906 |
| 147741 | 72400 | 72411 | CACCCACTGGTG | 1-10-1 MOE | 1055 |
| 147711 | 72446 | 72457 | AAGGGCCCTGGG | 1-10-1 MOE | 1040 |
| 398098 | 72574 | 72587 | TAACTTCAGTGTCT | 2-10-2 MOE | 1131 |
| 147742 | 72575 | 72586 | AACTTCAGTGTC | 1-10-1 MOE | 1041 |
| 147698 | 72595 | 72606 | CCCGCCACCACC | 1-10-1 MOE | 928 |
| 147743 | 72690 | 72701 | AGGGCTTCCAGT | 1-10-1 MOE | 1042 |
| 398099 | 72690 | 72703 | GAAGGGCTTCCAGT | 2-10-2 MOE | 1132 |
| 147744 | 72694 | 72705 | AGGAAGGGCTTC | 1-10-1 MOE | 1043 |
| 398100 | 72697 | 72710 | TGACCAGGAAGGGC | 2-10-2 MOE | 1133 |
| 147745 | 72700 | 72711 | TTGACCAGGAAG | 1-10-1 MOE | 1058 |
| 398098 | 72720 | 72733 | TAACTTCAGTGTCT | 2-10-2 MOE | 1131 |
| 147742 | 72721 | 72732 | AACTTCAGTGTC | 1-10-1 MOE | 1041 |
| 147698 | 72741 | 72752 | CCCGCCACCACC | 1-10-1 MOE | 928 |
| 398157 | 72757 | 72770 | GGAAACATACCCTG | 2-10-2 MOE | 1045 |
| 147743 | 72836 | 72847 | AGGGCTTCCAGT | 1-10-1 MOE | 1042 |
| 398099 | 72836 | 72849 | GAAGGGCTTCCAGT | 2-10-2 MOE | 1132 |
| 147744 | 72840 | 72851 | AGGAAGGGCTTC | 1-10-1 MOE | 1043 |
| 398100 | 72843 | 72856 | TGACCAGGAAGGGC | 2-10-2 MOE | 1133 |
| 147745 | 72846 | 72857 | TTGACCAGGAAG | 1-10-1 MOE | 1058 |
| 147076 | 72898 | 72909 | TTCCACTGATCC | 1-10-1 MOE | 1029 |
| 368357 | 72898 | 72911 | CCTTCCACTGATCC | 2-10-2 MOE | 1046 |
| 147077 | 72899 | 72910 | CTTCCACTGATC | 1-10-1 MOE | 1047 |
| 147078 | 72900 | 72911 | CCTTCCACTGAT | 1-10-1 MOE | 1044 |
| 398157 | 72903 | 72916 | GGAAACATACCCTG | 2-10-2 MOE | 1045 |
| 398158 | 72983 | 72996 | AGGCCCTGAGATTA | 2-10-2 MOE | 1134 |
| 398159 | 72988 | 73001 | GGTTAAGGCCCTGA | 2-10-2 MOE | 1135 |
| 398160 | 72993 | 73006 | GAATAGGTTAAGGC | 2-10-2 MOE | 1048 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147076 | 73044 | 73055 | TTCCACTGATCC | 1-10-1 MOE | 1029 |
| 368357 | 73044 | 73057 | CCTTCCACTGATCC | 2-10-2 MOE | 1046 |
| 147077 | 73045 | 73056 | CTTCCACTGATC | 1-10-1 MOE | 1047 |
| 147078 | 73046 | 73057 | CCTTCCACTGAT | 1-10-1 MOE | 1044 |
| 147746 | 73052 | 73063 | TAAAAACAACAA | 1-10-1 MOE | 1073 |
| 398161 | 73092 | 73105 | AACAATGTGTTGTA | 2-10-2 MOE | 1049 |
| 147746 | 73101 | 73112 | TAAAAACAACAA | 1-10-1 MOE | 1073 |
| 398158 | 73129 | 73142 | AGGCCCTGAGATTA | 2-10-2 MOE | 1134 |
| 398159 | 73134 | 73147 | GGTTAAGGCCCTGA | 2-10-2 MOE | 1135 |
| 398160 | 73139 | 73152 | GAATAGGTTAAGGC | 2-10-2 MOE | 1048 |
| 147746 | 73198 | 73209 | TAAAAACAACAA | 1-10-1 MOE | 1073 |
| 398161 | 73238 | 73251 | AACAATGTGTTGTA | 2-10-2 MOE | 1049 |
| 147746 | 73247 | 73258 | TAAAAACAACAA | 1-10-1 MOE | 1073 |
| 147088 | 73273 | 73284 | CCCTCTACACCA | 1-10-1 MOE | 1050 |
| 398105 | 73401 | 73414 | TGCACAGGCAGGTT | 2-10-2 MOE | 1066 |
| 398105 | 73547 | 73560 | TGCACAGGCAGGTT | 2-10-2 MOE | 1066 |
| 147741 | 73559 | 73570 | CACCCACTGGTG | 1-10-1 MOE | 1055 |
| 147741 | 73705 | 73716 | CACCCACTGGTG | 1-10-1 MOE | 1055 |
| 398162 | 73968 | 73981 | ACCAAACAGTTCAG | 2-10-2 MOE | 1057 |
| 147745 | 73991 | 74002 | TTGACCAGGAAG | 1-10-1 MOE | 1058 |
| 398167 | 74008 | 74019 | CAGGCCATGTGG | 1-10-1 MOE | 1059 |
| 398092 | 74009 | 74022 | AGTCAGGCCATGTG | 2-10-2 MOE | 1060 |
| 398162 | 74114 | 74127 | ACCAAACAGTTCAG | 2-10-2 MOE | 1057 |
| 147745 | 74137 | 74148 | TTGACCAGGAAG | 1-10-1 MOE | 1058 |
| 398167 | 74154 | 74165 | CAGGCCATGTGG | 1-10-1 MOE | 1059 |
| 147089 | 74280 | 74291 | TCCCTCTACACC | 1-10-1 MOE | 956 |
| 147090 | 74281 | 74292 | TTCCCTCTACAC | 1-10-1 MOE | 955 |
| 389949 | 74310 | 74321 | GCGCGAGCCCGA | 1-10-1 MOE | 1061 |
| 147740 | 74339 | 74350 | TGTGAGGCTCCA | 1-10-1 MOE | 1062 |
| 389950 | 74381 | 74392 | CCCTGAAGGTTC | 1-10-1 MOE | 1063 |
| 147089 | 74426 | 74437 | TCCCTCTACACC | 1-10-1 MOE | 956 |
| 147090 | 74427 | 74438 | TTCCCTCTACAC | 1-10-1 MOE | 955 |
| 389949 | 74456 | 74467 | GCGCGAGCCCGA | 1-10-1 MOE | 1061 |
| 147685 | 74490 | 74501 | GGCTGACATTCA | 1-10-1 MOE | 975 |
| 398101 | 74510 | 74523 | TTTGATAAAGCCCT | 2-10-2 MOE | 1064 |
| 398102 | 74536 | 74549 | CTACCTGAGGATTT | 2-10-2 MOE | 899 |
| 398103 | 74543 | 74556 | CCCAGTACTACCTG | 2-10-2 MOE | 900 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147685 | 74636 | 74647 | GGCTGACATTCA | 1-10-1 MOE | 975 |
| 398102 | 74682 | 74695 | CTACCTGAGGATTT | 2-10-2 MOE | 899 |
| 398103 | 74689 | 74702 | CCCAGTACTACCTG | 2-10-2 MOE | 900 |
| 147736 | 74737 | 74748 | AGGTAGGAGAAG | 1-10-1 MOE | 963 |
| 398104 | 74805 | 74818 | CAAGAAGACCTTAC | 2-10-2 MOE | 1065 |
| 147736 | 74883 | 74894 | AGGTAGGAGAAG | 1-10-1 MOE | 963 |
| 147737 | 74893 | 74904 | ACAGCCAGGTAG | 1-10-1 MOE | 1067 |
| 398105 | 74894 | 74907 | TGCACAGGCAGGTT | 2-10-2 MOE | 1066 |
| 147737 | 74919 | 74930 | ACAGCCAGGTAG | 1-10-1 MOE | 1067 |
| 398095 | 74940 | 74953 | CATCAGCAAGAGGC | 2-10-2 MOE | 1011 |
| 398104 | 74951 | 74964 | CAAGAAGACCTTAC | 2-10-2 MOE | 1065 |
| 398106 | 74974 | 74987 | TGGAAAACTGCACC | 2-10-2 MOE | 1068 |
| 398107 | 74980 | 74993 | TATTCCTGGAAAAC | 2-10-2 MOE | 902 |
| 147745 | 75030 | 75041 | TTGACCAGGAAG | 1-10-1 MOE | 1058 |
| 147737 | 75039 | 75050 | ACAGCCAGGTAG | 1-10-1 MOE | 1067 |
| 398105 | 75040 | 75053 | TGCACAGGCAGGTT | 2-10-2 MOE | 1066 |
| 147737 | 75065 | 75076 | ACAGCCAGGTAG | 1-10-1 MOE | 1067 |
| 398108 | 75077 | 75090 | GGAATGTCTGAGTT | 2-10-2 MOE | 1136 |
| 398095 | 75086 | 75099 | CATCAGCAAGAGGC | 2-10-2 MOE | 1011 |
| 147691 | 75108 | 75119 | GAGGTGGGAAAA | 1-10-1 MOE | 966 |
| 398106 | 75120 | 75133 | TGGAAAACTGCACC | 2-10-2 MOE | 1068 |
| 398107 | 75126 | 75139 | TATTCCTGGAAAAC | 2-10-2 MOE | 902 |
| 147738 | 75155 | 75166 | TGGGTGGCCGGG | 1-10-1 MOE | 1069 |
| 147745 | 75176 | 75187 | TTGACCAGGAAG | 1-10-1 MOE | 1058 |
| 398108 | 75223 | 75236 | GGAATGTCTGAGTT | 2-10-2 MOE | 1136 |
| 398109 | 75247 | 75260 | CAAGAAGTGTGGTT | 2-10-2 MOE | 903 |
| 147691 | 75254 | 75265 | GAGGTGGGAAAA | 1-10-1 MOE | 966 |
| 147738 | 75301 | 75312 | TGGGTGGCCGGG | 1-10-1 MOE | 1069 |
| 398110 | 75385 | 75398 | GTTCCCTTTGCAGG | 2-10-2 MOE | 952 |
| 147091 | 75387 | 75398 | GTTCCCTCTACA | 1-10-1 MOE | 1004 |
| 398109 | 75393 | 75406 | CAAGAAGTGTGGTT | 2-10-2 MOE | 903 |
| 398111 | 75470 | 75483 | GTGAAAATGCTGGC | 2-10-2 MOE | 904 |
| 401385 | 75494 | 75507 | CCCAGTGGGTTTGA | 2-10-2 MOE | 890 |
| 398166 | 75499 | 75510 | GGGCTTCTTCCA | 1-10-1 MOE | 1070 |
| 147091 | 75525 | 75536 | GTTCCCTCTACA | 1-10-1 MOE | 1004 |
| 147092 | 75526 | 75537 | TGTTCCCTCTAC | 1-10-1 MOE | 901 |
| 398110 | 75531 | 75544 | GTTCCCTTTGCAGG | 2-10-2 MOE | 952 |

TABLE 19-continued

Short antisense compounds targeted to SEQ
ID NO: 12 and having 1 or 2 mismatches

| ISIS NO. | 5' Target Site | 3' Target Site | Sequence (5'-3') | Gapmer Motif | Seq ID NO |
|---|---|---|---|---|---|
| 147091 | 75533 | 75544 | GTTCCCTCTACA | 1-10-1 MOE | 1004 |
| 147706 | 75540 | 75551 | GCTGACATCTCG | 1-10-1 MOE | 1071 |
| 398112 | 75584 | 75597 | CAGCCTGGCACCTA | 2-10-2 MOE | 1072 |
| 398111 | 75616 | 75629 | GTGAAAATGCTGGC | 2-10-2 MOE | 904 |
| 147746 | 75617 | 75628 | TAAAAACAACAA | 1-10-1 MOE | 1073 |
| 398166 | 75645 | 75656 | GGGCTTCTTCCA | 1-10-1 MOE | 1070 |
| 147091 | 75671 | 75682 | GTTCCCTCTACA | 1-10-1 MOE | 1004 |
| 147092 | 75672 | 75683 | TGTTCCCTCTAC | 1-10-1 MOE | 901 |
| 398113 | 75693 | 75706 | AGGAGGTTAAACCA | 2-10-2 MOE | 905 |
| 398112 | 75730 | 75743 | CAGCCTGGCACCTA | 2-10-2 MOE | 1072 |
| 147746 | 75763 | 75774 | TAAAAACAACAA | 1-10-1 MOE | 1073 |
| 398114 | 75770 | 75783 | AGGCATATAGCAGA | 2-10-2 MOE | 1075 |
| 398115 | 75786 | 75799 | AGTAAATATTGGCT | 2-10-2 MOE | 1076 |
| 398116 | 75799 | 75812 | TAATGACCTGATGA | 2-10-2 MOE | 1137 |
| 398113 | 75839 | 75852 | AGGAGGTTAAACCA | 2-10-2 MOE | 905 |
| 390030 | 75839 | 75850 | TTTATAAAACTG | 1-10-1 MOE | 1074 |
| 398115 | 75932 | 75945 | AGTAAATATTGGCT | 2-10-2 MOE | 1076 |
| 398116 | 75945 | 75958 | TAATGACCTGATGA | 2-10-2 MOE | 1137 |
| 398106 | 75982 | 75995 | TGGAAAACTGCACC | 2-10-2 MOE | 1068 |
| 390030 | 75985 | 75996 | TTTATAAAACTG | 1-10-1 MOE | 1074 |
| 398106 | 76127 | 76140 | TGGAAAACTGCACC | 2-10-2 MOE | 1068 |
| 147690 | 76196 | 76207 | TGAAGTTAATTC | 1-10-1 MOE | 1138 |
| 147690 | 76341 | 76352 | TGAAGTTAATTC | 1-10-1 MOE | 1138 |
| 147724 | 76740 | 76751 | GAAATTGAGGAA | 1-10-1 MOE | 1139 |
| 147089 | 76873 | 76884 | TCCCTCTACACC | 1-10-1 MOE | 956 |
| 147679 | 76881 | 76892 | CAAAAGGATCCC | 1-10-1 MOE | 907 |
| 147724 | 76885 | 76896 | GAAATTGAGGAA | 1-10-1 MOE | 1139 |
| 147089 | 77018 | 77029 | TCCCTCTACACC | 1-10-1 MOE | 956 |
| 147679 | 77026 | 77037 | CAAAAGGATCCC | 1-10-1 MOE | 907 |
| 147693 | 77240 | 77251 | GTGCGCTCCCAT | 1-10-1 MOE | 1078 |
| 147697 | 77759 | 77770 | CCCCAGCAGCGG | 1-10-1 MOE | 1000 |

In certain embodiments, a target region is nucleotides 177-190 of SEQ ID NO: 11. In certain embodiments, a short antisense compound is targeted to nucleotides 177-190 of SEQ ID NO: 11. In certain such embodiments, a short antisense compound targeted to nucleotides 177-190 comprises a nucleotide sequence selected from SEQ ID NO 886, 859, or 853. In certain such embodiments, a short antisense compound targeted to nucleotides 177-190 of SEQ ID NO: 11 is selected from Isis No 147022, 147023, or 147024.

In certain embodiments, a target region is nucleotides 195-228 of SEQ ID NO: 11. In certain embodiments, a short antisense compound is targeted to nucleotides 195-228 of SEQ ID NO: 11. In certain such embodiments, a short antisense compound targeted to nucleotides 195-228 comprises a nucleotide sequence selected from SEQ ID NO 877, 868, 882, 886, 859, 853, 865, 835, 843, 846, 842, 848, 874, 849, 863, 855, 850, 864, or 834. In certain such embodiments, a short antisense compound targeted to nucleotides 195-228 of SEQ ID NO: 11 is selected from Isis No 147019, 147020, 147021, 147022, 147023, 147024, 147025, 147026, 147027, 147028, 147073, 147029, 147030, 147036, 147037, 147038, 147039, 147040, or 147041.

In certain embodiments, a target region is nucleotides 323-353 of SEQ ID NO: 11. In certain embodiments, a short antisense compound is targeted to nucleotides 323-353 of SEQ ID NO: 11. In certain such embodiments, a short antisense compound targeted to nucleotides 323-353 comprises a nucleotide sequence selected from SEQ ID NO 866, 881, 869, 883, 858, 833, 875, 837, 829, 871, 884, 887, 839, 830, 840, 861, or 879. In certain such embodiments, a short antisense compound targeted to nucleotides 323-353 of SEQ ID NO: 11 is selected from Isis No 147042, 147043, 147044, 147045, 147046, 147047, 147051, 147052, 147053, 147054, 147055, 147056, 147057, 147058, 147059, 147060, or 147061.

In certain embodiments, a target region is nucleotides 322-353 of SEQ ID NO: 11. In certain embodiments, a short antisense compound is targeted to nucleotides 322-353 of SEQ ID NO: 11. In certain such embodiments, a short antisense compound targeted to nucleotides 322-353 comprises a nucleotide sequence selected from SEQ ID NO 842, 866, 881, 869, 883, 858, 833, 875, 837, 829, 871, 884, 887, 839, 830, 840, 861, or 879. In certain such embodiments, a short antisense compound targeted to nucleotides 322-353 of SEQ ID NO: 11 is selected from Isis No 147073, 147042, 147043, 147044, 147045, 147046, 147047, 147051, 147052, 147053, 147054, 147055, 147056, 147057, 147058, 147059, 147060, or 147061.

In certain embodiments, a target region is nucleotides 679-799 of SEQ ID NO: 11. In certain embodiments, a short antisense compound is targeted to nucleotides 679-799 of SEQ ID NO: 11. In certain such embodiments, a short antisense compound targeted to nucleotides 679-799 comprises a nucleotide sequence selected from SEQ ID NO 883, 858, 883, or 858. In certain such embodiments, a short antisense compound targeted to nucleotides 679-799 of SEQ ID NO: 11 is selected from Isis No 147045, 147046, 147045, or 147046.

In certain embodiments, a target region is nucleotides 679-827 of SEQ ID NO: 11. In certain embodiments, a short antisense compound is targeted to nucleotides 679-827 of SEQ ID NO: 11. In certain such embodiments, a short antisense compound targeted to nucleotides 679-827 comprises a nucleotide sequence selected from SEQ ID NO 883, 858, 883, 858, or 851. In certain such embodiments, a short antisense compound targeted to nucleotides 679-827 of SEQ ID NO: 11 is selected from Isis No 147045, 147046, 147045, 147046, or 147066.

In certain embodiments, a target region is nucleotides 1024-1046 of SEQ ID NO: 11. In certain embodiments, a short antisense compound is targeted to nucleotides 1024-1046 of SEQ ID NO: 11. In certain such embodiments, a short antisense compound targeted to nucleotides 1024-1046 comprises a nucleotide sequence selected from SEQ ID NO 841, 862, 880, 857, 851, 876, 838, 860, 878, 856, 832, or 842. In certain such embodiments, a short antisense compound targeted to nucleotides 1024-1046 of SEQ ID NO: 11 is selected from Isis No 147062, 147063, 147064, 147065, 147066, 147067, 147068, 147069, 147070, 147071, 147072, or 147073.

In certain embodiments, a target region is nucleotides 992-1046 of SEQ ID NO: 11. In certain embodiments, a short antisense compound is targeted to nucleotides 992-1046 of SEQ ID NO: 11. In certain such embodiments, a short antisense compound targeted to nucleotides 992-1046 comprises a nucleotide sequence selected from SEQ ID NO 831, 841, 862, 880, 857, 851, 876, 838, 860, 878, 856, 832, or 842. In certain such embodiments, a short antisense compound targeted to nucleotides 992-1046 of SEQ ID NO: 11 is selected from Isis No 404131, 147062, 147063, 147064, 147065, 147066, 147067, 147068, 147069, 147070, 147071, 147072, or 147073.

In certain embodiments, a target region is nucleotides 1868-1881 of SEQ ID NO: 11. In certain embodiments, a short antisense compound is targeted to nucleotides 1868-1881 of SEQ ID NO: 11. In certain such embodiments, a short antisense compound targeted to nucleotides 1868-1881 comprises a nucleotide sequence selected from SEQ ID NO 886, 859, or 853. In certain such embodiments, a short antisense compound targeted to nucleotides 1868-1881 of SEQ ID NO: 11 is selected from Isis No 147022, 147023, or 147024.

In certain embodiments, a target region is nucleotides 1886-1919 of SEQ ID NO: 11. In certain embodiments, a short antisense compound is targeted to nucleotides 1886-1919 of SEQ ID NO: 11. In certain such embodiments, a short antisense compound targeted to nucleotides 1886-1919 comprises a nucleotide sequence selected from SEQ ID NO 877, 868, 882, 886, 859, 865, 843, 846, 874, 863, 855, 864, or 834. In certain such embodiments, a short antisense compound targeted to nucleotides 1886-1919 of SEQ ID NO: 11 is selected from Isis No 147019, 147020, 147021, 147022, 147023, 147025, 147027, 147028, 147030, 147037, 147038, 147040, or 147041.

In certain embodiments, a target region is nucleotides 1869-1919 of SEQ ID NO: 11. In certain embodiments, a short antisense compound is targeted to nucleotides 1869-1919 of SEQ ID NO: 11. In certain such embodiments, a short antisense compound targeted to nucleotides 1869-1919 comprises a nucleotide sequence selected from SEQ ID NO 859, 853, 877, 868, 882, 886, 859, 865, 843, 846, 874, 863, 855, 864, or 834. In certain such embodiments, a short antisense compound targeted to nucleotides 1869-1919 of SEQ ID NO: 11 is selected from Isis No 147023, 147024, 147019, 147020, 147021, 147022, 147023, 147025, 147027, 147028, 147030, 147037, 147038, 147040, or 147041.

In certain embodiments, a target region is nucleotides 1976-1989 of SEQ ID NO: 11. In certain embodiments, a short antisense compound is targeted to nucleotides 1976-1989 of SEQ ID NO: 11. In certain such embodiments, a short antisense compound targeted to nucleotides 1976-1989 comprises a nucleotide sequence selected from SEQ ID NO 886, 859, or 853. In certain such embodiments, a short antisense compound targeted to nucleotides 1976-1989 of SEQ ID NO: 11 is selected from Isis No 147022, 147023, or 147024.

In certain embodiments, a target region is nucleotides 1995-2027 of SEQ ID NO: 11. In certain embodiments, a short antisense compound is targeted to nucleotides 1995-2027 of SEQ ID NO: 11. In certain such embodiments, a short antisense compound targeted to nucleotides 1995-2027 comprises a nucleotide sequence selected from SEQ ID NO 868, 882, 886, 859, 853, 865, 835, 843, 846, 848, 874, 849, 863, 855, 850, 864, or 834. In certain such embodiments, a short antisense compound targeted to nucleotides 1995-2027 of SEQ ID NO: 11 is selected from Isis No 147020, 147021, 147022, 147023, 147024, 147025, 147026, 147027, 147028, 147029, 147030, 147036, 147037, 147038, 147039, 147040, or 147041.

In certain embodiments, a target region is nucleotides 2366-2382 of SEQ ID NO: 11. In certain embodiments, a short antisense compound is targeted to nucleotides 2366-2382 of SEQ ID NO: 11. In certain such embodiments, a short antisense compound targeted to nucleotides 2366-2382 comprises a nucleotide sequence selected from SEQ ID NO 867 or 873. In certain such embodiments, a short antisense compound targeted to nucleotides 2366-2382 of SEQ ID NO: 11 is selected from Isis No 404199 or 404134.

In certain embodiments, a target region is nucleotides 6220-6233 of SEQ ID NO: 11. In certain embodiments, a short antisense compound is targeted to nucleotides 6220-6233 of SEQ ID NO: 11. In certain such embodiments, a short antisense compound targeted to nucleotides 6220-6233 comprises a nucleotide sequence selected from SEQ ID NO 870, 836, or 844. In certain such embodiments, a short antisense compound targeted to nucleotides 6220-6233 of SEQ ID NO: 11 is selected from Isis No 147032, 147033, or 147034.

In certain embodiments, a target region is nucleotides 6288-6300 of SEQ ID NO: 11. In certain embodiments, a short antisense compound is targeted to nucleotides 6288-6300 of SEQ ID NO: 11. In certain such embodiments, a short antisense compound targeted to nucleotides 6288-6300 comprises a nucleotide sequence selected from SEQ ID NO 869 or 883. In certain such embodiments, a short antisense compound targeted to nucleotides 6288-6300 of SEQ ID NO: 11 is selected from Isis No 147044 or 147045.

In certain embodiments, a target region is nucleotides 6329-6342 of SEQ ID NO: 11. In certain embodiments, a short antisense compound is targeted to nucleotides 6329-6342 of SEQ ID NO: 11. In certain such embodiments, a short antisense compound targeted to nucleotides 6329-6342 comprises a nucleotide sequence selected from SEQ ID NO 870, 836, or 844. In certain such embodiments, a short antisense compound targeted to nucleotides 6329-6342 of SEQ ID NO: 11 is selected from Isis No 147032, 147033, or 147034.

In certain embodiments, a target region is nucleotides 6397-6409 of SEQ ID NO: 11. In certain embodiments, a short antisense compound is targeted to nucleotides 6397-6409 of SEQ ID NO: 11. In certain such embodiments, a short antisense compound targeted to nucleotides 6397-6409 comprises a nucleotide sequence selected from SEQ ID NO 869 or 883. In certain such embodiments, a short antisense compound targeted to nucleotides 6397-6409 of SEQ ID NO: 11 is selected from Isis No 147044 or 147045.

In certain embodiments, a target region is nucleotides 7057-7178 of SEQ ID NO: 11. In certain embodiments, a short antisense compound is targeted to nucleotides 7057-7178 of SEQ ID NO: 11. In certain such embodiments, a short antisense compound targeted to 7057-7178 comprises a nucleotide sequence selected from SEQ ID NO 830, 840, 861, 830, or 840. In certain such embodiments, a short antisense compound targeted to nucleotides 7057-7178 of SEQ ID NO: 11 is selected from Isis No 147058, 147059, 147060, 147058, or 147059.

In certain embodiments, a target region is nucleotides 8630-8750 of SEQ ID NO: 11. In certain embodiments, a short antisense compound is targeted to nucleotides 8630-8750 of SEQ ID NO: 11. In certain such embodiments, a short antisense compound targeted to 8630-8750 comprises a nucleotide sequence selected from SEQ D) NO 843, 846, 843, or 846. In certain such embodiments, a short antisense compound targeted to nucleotides 8630-8750 of SEQ ID NO: 11 is selected from Isis No 147027, 147028, 147027, or 147028.

In certain embodiments, a target region is nucleotides 10957-11077 of SEQ ID NO: 11. In certain embodiments, a short antisense compound is targeted to nucleotides 10957-11077 of SEQ ID NO: 11. In certain such embodiments, a short antisense compound targeted to 10957-11077 comprises a nucleotide sequence selected from SEQ ID NO 881, 869, 881, or 869. In certain such embodiments, a short antisense compound targeted to nucleotides 10957-11077 of SEQ ID NO: 11 is selected from Isis No 147043, 147044, 147043, or 147044.

In certain embodiments, a target region is nucleotides 11605-11623 of SEQ ID NO: 11. In certain embodiments, a short antisense compound is targeted to nucleotides 11605-11623 of SEQ ID NO: 11. In certain such embodiments, a short antisense compound targeted to 11605-11623 comprises a nucleotide sequence selected from SEQ ID NO 856, 878, or 856. In certain such embodiments, a short antisense compound targeted to nucleotides 11605-11623 of SEQ ID NO: 11 is selected from Isis No 147071, 147070, or 147071.

In certain embodiments, a target region is nucleotides 12805-12817 of SEQ ID NO: 11. In certain embodiments, a short antisense compound is targeted to nucleotides 12805-12817 of SEQ ID NO: 11. In certain such embodiments, a short antisense compound targeted to 12805-12817 comprises a nucleotide sequence selected from SEQ ID NO 874 or 885. In certain such embodiments, a short antisense compound targeted to nucleotides 12805-12817 of SEQ ID NO: 11 is selected from Isis No 147030 or 147031.

In certain embodiments, a target region is nucleotides 12986-12998 of SEQ ID NO: 11. In certain embodiments, a short antisense compound is targeted to nucleotides 12986-12998 of SEQ ID NO: 11. In certain such embodiments, a short antisense compound targeted to 12986-12998 comprises a nucleotide sequence selected from SEQ ID NO 874 or 885. In certain such embodiments, a short antisense compound targeted to nucleotides 12986-12998 of SEQ ID NO: 11 is selected from Isis No 147030 or 147031.

In certain embodiments, a target region is nucleotides 15560-15572 of SEQ ID NO: 11. In certain embodiments, a short antisense compound is targeted to nucleotides 15560-15572 of SEQ ID NO: 11. In certain such embodiments, a short antisense compound targeted to 15560-15572 comprises a nucleotide sequence selected from SEQ ID NO 876 or 838. In certain such embodiments, a short antisense compound targeted to nucleotides 15560-15572 of SEQ ID NO: 11 is selected from Isis No 147067 or 147068.

In certain embodiments, a target region is nucleotides 17787-17941 of SEQ ID NO: 11. In certain embodiments, a short antisense compound is targeted to nucleotides 17787-17941 of SEQ ID NO: 11. In certain such embodiments, a short antisense compound targeted to 17787-17941 comprises a nucleotide sequence selected from SEQ ID NO 874 or 880. In certain such embodiments, a short antisense compound targeted to nucleotides 17787-17941 of SEQ ID NO: 11 is selected from Isis No 147030 or 147064.

In certain embodiments, a target region is nucleotides 21190-21202 of SEQ ID NO: 11. In certain embodiments, a short antisense compound is targeted to nucleotides 21190-21202 of SEQ ID NO: 11. In certain such embodiments, a short antisense compound targeted to 21190-21202 comprises a nucleotide sequence selected from SEQ ID NO 843 or 846. In certain such embodiments, a short antisense compound targeted to nucleotides 21190-21202 of SEQ ID NO: 11 is selected from Isis No 147027 or 147028.

In certain embodiments, a target region is nucleotides 21358-21370 of SEQ ID NO: 11. In certain embodiments, a short antisense compound is targeted to nucleotides 21358-21370 of SEQ ID NO: 11. In certain such embodiments, a short antisense compound targeted to 21358-21370 comprises a nucleotide sequence selected from SEQ ID NO 843 or 846. In certain such embodiments, a short antisense compound targeted to nucleotides 21358-21370 of SEQ ID NO: 11 is selected from Isis No 017027 or 147028.

In certain embodiments, a target region is nucleotides 24318-24332 of SEQ ID NO: 11. In certain embodiments, a short antisense compound is targeted to nucleotides 24318-24332 of SEQ ID NO: 11. In certain such embodiments, a short antisense compound targeted to 24318-24332 comprises a nucleotide sequence selected from SEQ ID NO 881, 869, 883, or 858. In certain such embodiments, a short antisense compound targeted to nucleotides 24318-24332 of SEQ ID NO: 11 is selected from Isis No 147043, 147044, 147045, or 147046.

In certain embodiments, a target region is nucleotides 24486-24501 of SEQ ID NO: 11. In certain embodiments, a short antisense compound is targeted to nucleotides 24486-24501 of SEQ ID NO: 11. In certain such embodiments, a short antisense compound targeted to 24486-24501 comprises a nucleotide sequence selected from SEQ ID NO 881, 869, 858, or 833. In certain such embodiments, a short antisense compound targeted to nucleotides 24486-24501 of SEQ ID NO: 11 is selected from Isis No 147043, 147044, 147046, or 147047.

In certain embodiments, a target region is nucleotides 25065-25077 of SEQ ID NO: 11. In certain embodiments, a short antisense compound is targeted to nucleotides 25065-25077 of SEQ ID NO: 11. In certain such embodiments, a short antisense compound targeted to 25065-25077 comprises a nucleotide sequence selected from SEQ ID NO 864 or 834. In certain such embodiments, a short antisense compound targeted to nucleotides 25065-25077 of SEQ ID NO: 11 is selected from Isis No 147040 or 147041.

In certain embodiments, a target region is nucleotides 25232-25245 of SEQ ID NO: 11. In certain embodiments, a short antisense compound is targeted to nucleotides 25232-25245 of SEQ ID NO: 11. In certain such embodiments, a short antisense compound targeted to 25232-25245 comprises a nucleotide sequence selected from SEQ ID NO 850, 864, or 834. In certain such embodiments, a short antisense compound targeted to nucleotides 25232-25245 of SEQ ID NO: 11 is selected from Isis No 147039, 147040, or 147041.

In certain embodiments, a target region is nucleotides 25508-25523 of SEQ ID NO: 11. In certain embodiments, a short antisense compound is targeted to nucleotides 25508-25523 of SEQ ID NO: 11. In certain such embodiments, a short antisense compound targeted to 25508-25523 comprises a nucleotide sequence selected from SEQ ID NO 839 or 879. In certain such embodiments, a short antisense compound targeted to nucleotides 25508-25523 of SEQ ID NO: 11 is selected from Isis No 147057 or 147061.

In certain embodiments, a target region is nucleotides 25676-28890 of SEQ ID NO: 11. In certain embodiments, a short antisense compound is targeted to nucleotides 25676-28890 of SEQ ID NO:11. In certain such embodiments, a short antisense compound targeted to 25676-28890 comprises a nucleotide sequence selected from SEQ ID NO 839, 860, or 878. In certain such embodiments, a short antisense compound targeted to nucleotides 25676-28890 of SEQ ID NO: 11 is selected from Isis No 147057, 147069, or 147070.

In certain embodiments, a target region is nucleotides 33056-33069 of SEQ ID NO: 11. In certain embodiments, a short antisense compound is targeted to nucleotides 33056-33069 of SEQ ID NO: 11. In certain such embodiments, a short antisense compound targeted to 33056-33069 comprises a nucleotide sequence selected from SEQ ID NO 860, 878, or 856. In certain such embodiments, a short antisense compound targeted to nucleotides 33056-33069 of SEQ ID NO: 11 is selected from Isis No 147069, 147070, or 147071.

In certain embodiments, a target region is nucleotides 33205-33217 of SEQ ID NO: 11. In certain embodiments, a short antisense compound is targeted to nucleotides 33205-33217 of SEQ ID NO: 11. In certain such embodiments, a short antisense compound targeted to 33205-33217 comprises a nucleotide sequence selected from SEQ ID NO 878 or 856. In certain such embodiments, a short antisense compound targeted to nucleotides 33205-33217 of SEQ ID NO: 11 is selected from Isis No 14707 or 147071.

In certain embodiments, a target region is nucleotides 33318-33334 of SEQ ID NO: 11. In certain embodiments, a short antisense compound is targeted to nucleotides 33318-33334 of SEQ ID NO: 11. In certain such embodiments, a short antisense compound targeted to 33318-33334 comprises a nucleotide sequence selected from SEQ ID NO 858, 854, or 875. In certain such embodiments, a short antisense compound targeted to nucleotides 33318-33334 of SEQ ID NO: 11 is selected from Isis No 147046, 147049, or 147051.

In certain embodiments, a target region is nucleotides 33466-33482 of SEQ ID NO: 11. In certain embodiments, a short antisense compound is targeted to nucleotides 33466-33482 of SEQ ID NO: 11. In certain such embodiments, a short antisense compound targeted 33466-33482 comprises a nucleotide sequence selected from SEQ ID NO 858, 833, or 875. In certain such embodiments, a short antisense compound targeted to nucleotides 33466-33482 of SEQ ID NO: 11 is selected from Isis No 147046, 147047, or 147051.

In certain embodiments, a target region is nucleotides 33640-33656 of SEQ ID NO: 11. In certain embodiments, a short antisense compound is targeted to nucleotides 33640-33656 of SEQ ID NO: 11. In certain such embodiments, a short antisense compound targeted 33640-33656 comprises a nucleotide sequence selected from SEQ ID NO 858 or 875. In certain such embodiments, a short antisense compound targeted to nucleotides 33640-33656 of SEQ ID NO: 11 is selected from Isis No 147046 or 147051.

In certain embodiments, a target region is nucleotides 33788-33804 of SEQ ID NO: 11. In certain embodiments, a short antisense compound is targeted to nucleotides 33788-33804 of SEQ ID NO: 11. In certain such embodiments, a short antisense compound targeted 33788-33804 comprises a nucleotide sequence selected from SEQ ID NO 858 or 875. In certain such embodiments, a short antisense compound targeted to nucleotides 33788-33804 of SEQ ID NO: 11 is selected from Isis No 147046 or 147051.

In certain embodiments, a target region is nucleotides 35437-35449 of SEQ ID NO: 11. In certain embodiments, a short antisense compound is targeted to nucleotides 35437-35449 of SEQ ID NO: 11. In certain such embodiments, a short antisense compound targeted 35437-35449 comprises a nucleotide sequence selected from SEQ ID NO 840 or 861. In certain such embodiments, a short antisense compound targeted to nucleotides 35437-35449 of SEQ ID NO: 11 is selected from Isis No 147059 or 147060.

In certain embodiments, a target region is nucleotides 40353-40373 of SEQ ID NO: 11. In certain embodiments, a short antisense compound is targeted to nucleotides 40353-40373 of SEQ ID NO: 11. In certain such embodiments, a short antisense compound targeted 40353-40373 comprises a nucleotide sequence selected from SEQ ID NO 879 or 881. In certain such embodiments, a short antisense compound targeted to nucleotides 40353-40373 of SEQ ID NO: 11 is selected from Isis No 147061 or 147043.

In certain embodiments, a target region is nucleotides 42527-42541 of SEQ ID NO: 11. In certain embodiments, a short antisense compound is targeted to nucleotides 4252742541 of SEQ ID NO: 11. In certain such embodiments, a short antisense compound targeted 42527-42541 comprises a nucleotide sequence selected from SEQ ID NO 885, 870, or 844. In certain such embodiments, a short antisense compound targeted to nucleotides 42527-42541 of SEQ ID NO: 11 is selected from Isis No 147031, 147032, or 147034.

In certain embodiments, a target region is nucleotides 42675-42689 of SEQ ID NO: 11. In certain embodiments, a short antisense compound is targeted to nucleotides 42675-42689 of SEQ ID NO: 11. In certain such embodiments, a short antisense compound targeted 42675-42689 comprises a nucleotide sequence selected from SEQ ID NO 885, 870, 836, or 844. In certain such embodiments, a short antisense compound targeted to nucleotides 42675-42689 of SEQ ID NO: 11 is selected from Isis No 147031, 147032, 147033, or 147034.

In certain embodiments, a target region is nucleotides 46313-46328 of SEQ ID NO: 11. In certain embodiments, a short antisense compound is targeted to nucleotides 46313-46328 of SEQ ID NO: 11. In certain such embodiments, a short antisense compound targeted 46313-46328 comprises a nucleotide sequence selected from SEQ ID NO 839, 830, 840, or 879. In certain such embodiments, a short antisense compound targeted to nucleotides 46313-46328 of SEQ ID NO: 11 is selected from Isis No 147057, 147058, 147059, or 147061.

In certain embodiments, a target region is nucleotides 46461-46476 of SEQ ID NO: 11. In certain embodiments, a short antisense compound is targeted to nucleotides 46461-46476 of SEQ ID NO: 11. In certain such embodiments, a short antisense compound targeted 46461-46476 comprises a nucleotide sequence selected from SEQ ID NO 839, 840, or 879. In certain such embodiments, a short antisense compound targeted to nucleotides 46461-46476 of SEQ ID NO: 11 is selected from Isis No 147057, 147059, or 147061.

In certain embodiments, a target region is nucleotides 48369-48381 of SEQ ID NO: 11. In certain embodiments, a short antisense compound is targeted to nucleotides 48369-48381 of SEQ ID NO: 11. In certain such embodiments, a short antisense compound targeted 48369-48381 comprises a nucleotide sequence selected from SEQ ID NO 842 or 845. In certain such embodiments, a short antisense compound targeted to nucleotides 48369-48381 of SEQ ID NO: 11 is selected from Isis No 147073 or 147074.

In certain embodiments, a target region is nucleotides 48714-48726 of SEQ ID NO: 11. In certain embodiments, a short antisense compound is targeted to nucleotides 48714-48726 of SEQ ID NO: 11. In certain such embodiments, a short antisense compound targeted 48714-48726 comprises a nucleotide sequence selected from SEQ ID NO 843 or 846. In certain such embodiments, a short antisense compound targeted to nucleotides 48714-48726 of SEQ ID NO: 11 is selected from Isis No 147027 or 147028.

In certain embodiments, a target region is nucleotides 49050-49062 of SEQ ID NO: 11. In certain embodiments, a short antisense compound is targeted to nucleotides 49050-49062 of SEQ ID NO: 11. In certain such embodiments, a short antisense compound targeted 49050-49062 of comprises a nucleotide sequence selected from SEQ ID NO 876 or 838. In certain such embodiments, a short antisense compound targeted to nucleotides 49050-49062 of SEQ ID NO: 11 is selected from Isis No 147067 or 147068.

In certain embodiments, a target region is nucleotides 49672-49684 of SEQ ID NO: 11. In certain embodiments, a short antisense compound is targeted to nucleotides 49672-49684 of SEQ ID NO: 11. In certain such embodiments, a short antisense compound targeted 49672-49684 of comprises a nucleotide sequence selected from SEQ ID NO 842 or 845. In certain such embodiments, a short antisense compound targeted to nucleotides 49672-49684 of SEQ ID NO: 11 is selected from Isis No 147073 or 147074.

In certain embodiments, a target region is nucleotides 52292-52304 of SEQ ID NO: 11. In certain embodiments, a short antisense compound is targeted to nucleotides 52292-52304 of SEQ ID NO: 11. In certain such embodiments, a short antisense compound targeted 52292-52304 of comprises a nucleotide sequence selected from SEQ ID NO 849 or 863. In certain such embodiments, a short antisense compound targeted to nucleotides 52292-52304 of SEQ ID NO: 11 is selected from Isis No 147036 or 147037.

In certain embodiments, a target region is nucleotides 52438-52450 of SEQ ID NO: 11. In certain embodiments, a short antisense compound is targeted to nucleotides 52438-52450 of SEQ ID NO: 11. In certain such embodiments, a short antisense compound targeted 52438-52450 of comprises a nucleotide sequence selected from SEQ ID NO 849 or 863. In certain such embodiments, a short antisense compound targeted to nucleotides 52438-52450 of SEQ ID NO: 11 is selected from Isis No 147036 or 147037.

In certain embodiments, a target region is nucleotides 53445-53458 of SEQ ID NO: 11. In certain embodiments, a short antisense compound is targeted to nucleotides 53445-53458 of SEQ ID NO: 11. In certain such embodiments, a short antisense compound targeted 53445-53458 of comprises a nucleotide sequence selected from SEQ ID NO 866, 881, or 869. In certain such embodiments, a short antisense compound targeted to nucleotides 53445-53458 of SEQ ID NO: 11 is selected from Isis No 147042, 147043, or 147044.

In certain embodiments, a target region is nucleotides 53591-53604 of SEQ ID NO: 11. In certain embodiments, a short antisense compound is targeted to nucleotides 53591-53604 of SEQ ID NO: 11. In certain such embodiments, a short antisense compound targeted 53591-53604 of comprises a nucleotide sequence selected from SEQ ID NO 866, 874, 881, 885, or 869. In certain such embodiments, a short antisense compound targeted to nucleotides 53591-53604 of SEQ ID NO: 11 is selected from Isis No 147042, 147030, 147043, 147031, or 147044.

In certain embodiments, a target region is nucleotides 53738-53750 of SEQ ID NO: 11. In certain embodiments, a short antisense compound is targeted to nucleotides 53738-53750 of SEQ ID NO: 11. In certain such embodiments, a short antisense compound targeted 53738-53750 of comprises a nucleotide sequence selected from SEQ ID NO 874 or 885. In certain such embodiments, a short antisense compound targeted to nucleotides 53738-53750 of SEQ ID NO: 11 is selected from Isis No 147030 or 147031.

In certain embodiments, a target region is nucleotides 53783-53795 of SEQ ID NO: 11. In certain embodiments, a short antisense compound is targeted to nucleotides 53783-53795 of SEQ ID NO: 11. In certain such embodiments, a short antisense compound targeted 53783-53795 of comprises a nucleotide sequence selected from SEQ ID NO 864 or 834. In certain such embodiments, a short antisense compound targeted to nucleotides 53783-53795 of SEQ ID NO: 11 is selected from Isis No 147040 or 147041.

In certain embodiments, a target region is nucleotides 55008-55020 of SEQ ID NO: 11. In certain embodiments, a short antisense compound is targeted to nucleotides 55008-55020 of SEQ ID NO: 11. In certain such embodiments, a short antisense compound targeted 55008-55020 of comprises a nucleotide sequence selected from SEQ ID NO 866 or 881. In certain such embodiments, a short antisense compound targeted to nucleotides 55008-55020 of SEQ ID NO: 11 is selected from Isis No 147042 or 147043.

In certain embodiments, a target region is nucleotides 55154-55166 of SEQ ID NO: 11. In certain embodiments, a short antisense compound is targeted to nucleotides 55154-55166 of SEQ ID NO: 11. In certain such embodiments, a short antisense compound targeted 55154-55166 of comprises a nucleotide sequence selected from SEQ ID NO 866 or 881. In certain such embodiments, a short antisense compound targeted to nucleotides 55154-55166 of SEQ ID NO: 11 is selected from Isis No 147042 or 147043.

In certain embodiments, a target region is nucleotides 55682-55695 of SEQ ID NO: 11. In certain embodiments, a short antisense compound is targeted to nucleotides 55682-55695 of SEQ ID NO: 11. In certain such embodiments, a short antisense compound targeted 55682-55695 of comprises a nucleotide sequence selected from SEQ ID NO 877 or 882. In certain such embodiments, a short antisense compound targeted to nucleotides 55682-55695 of SEQ ID NO: 11 is selected from Isis No 147019 or 147021.

In certain embodiments, a target region is nucleotides 56275-56293 of SEQ ID NO: 11. In certain embodiments, a short antisense compound is targeted to nucleotides 56275-56293 of SEQ ID NO: 11. In certain such embodiments, a short antisense compound targeted 56275-56293 of comprises a nucleotide sequence selected from SEQ ID NO 871, 884, 887, 830, 840, 861, or 879. In certain such embodiments, a short antisense compound targeted to nucleotides 56275-56293 of SEQ ID NO: 11 is selected from Isis No 147054, 147055, 147056, 147058, 147059, 147060, or 147061.

In certain embodiments, a target region is nucleotides 56418-56439 of SEQ ID NO: 11. In certain embodiments, a short antisense compound is targeted to nucleotides 56418-56439 of SEQ ID NO: 11. In certain such embodiments, a short antisense compound targeted 56418-56439 of comprises a nucleotide sequence selected from SEQ ID NO 875, 829, 871, 884, 887, 839, 830, or 879. In certain such embodiments, a short antisense compound targeted to nucleotides 56418-56439 of SEQ ID NO: 11 is selected from Isis No 147051, 147053, 147054, 147055, 147056, 147057, 147058, or 147061.

In certain embodiments, a target region is nucleotides 57264-57276 of SEQ ID NO: 11. In certain embodiments, a short antisense compound is targeted to nucleotides 57264-57276 of SEQ ID NO: 11. In certain such embodiments, a short antisense compound targeted 57264-57276 of comprises a nucleotide sequence selected from SEQ ID NO 883 or 858. In certain such embodiments, a short antisense compound targeted to nucleotides 57264-57276 of SEQ ID NO: 11 is selected from Isis No 147045 or 147046.

In certain embodiments, a target region is nucleotides 61276-61293 of SEQ ID NO: 11. In certain embodiments, a short antisense compound is targeted to nucleotides 61276-61293 of SEQ ID NO: 11. In certain such embodiments, a short antisense compound targeted 61276-61293 of comprises a nucleotide sequence selected from SEQ ID NO 856, 847, 849, 863, 855, 850, or 864. In certain such embodiments, a short antisense compound targeted to nucleotides 61276-61293 of SEQ ID NO: 11 is selected from Isis No 147071, 147035, 147036, 147037, 147038, 147039, or 147040.

In certain embodiments, a target region is nucleotides 61257-61320 of SEQ ID NO: 11. In certain embodiments, a short antisense compound is targeted to nucleotides 61257-61320 of SEQ ID NO: 11. In certain such embodiments, a short antisense compound targeted 61257-61320 of comprises a nucleotide sequence selected from SEQ ID NO 881, 856, 847, 849, 863, 855, 850, 864, or 886. In certain such embodiments, a short antisense compound targeted to nucleotides 61257-61320 of SEQ ID NO: 11 is selected from Isis No 147043, 147071, 147035, 147036, 147037, 147038, 147039, 147040, or 147071.

In certain embodiments, a target region is nucleotides 61422-61439 of SEQ ID NO: 11. In certain embodiments, a short antisense compound is targeted to nucleotides 61422-61439 of SEQ ID NO: 11. In certain such embodiments, a short antisense compound targeted 61422-61439 of comprises a nucleotide sequence selected from SEQ ID NO 844, 847, 849, 863, 855, or 864. In certain such embodiments, a short antisense compound targeted to nucleotides 61422-61439 of SEQ ID NO: 11 is selected from Isis No 147034, 147035, 147036, 147037, 147038, or 147040.

In certain embodiments, a target region is nucleotides 61422-61466 of SEQ ID NO: 11. In certain embodiments, a short antisense compound is targeted to nucleotides 61422-61466 of SEQ ID NO: 11. In certain such embodiments, a short antisense compound targeted 61422-61466 of comprises a nucleotide sequence selected from SEQ ID NO 844, 847, 849, 863, 855, 864, or 856. In certain such embodiments, a short antisense compound targeted to nucleotides 61422-61466 of SEQ ID NO: 11 is selected from Isis No 147034, 147035, 147036, 147037, 147038, 147040, or 147071.

In certain embodiments, a target region is nucleotides 63065-63078 of SEQ ID NO: 11. In certain embodiments, a short antisense compound is targeted to nucleotides 63065-63078 of SEQ ID NO: 11. In certain such embodiments, a short antisense compound targeted 63065-63078 of comprises a nucleotide sequence selected from SEQ ID NO 851 or 838. In certain such embodiments, a short antisense compound targeted to nucleotides 63065-63078 of SEQ ID NO: 11 is selected from Isis No 147066 or 147068.

In certain embodiments, a target region is nucleotides 63207-63222 of SEQ ID NO: 11. In certain embodiments, a short antisense compound is targeted to nucleotides 63207-63222 of SEQ ID NO: 11. In certain such embodiments, a short antisense compound targeted 63207-63222 of comprises a nucleotide sequence selected from SEQ ID NO 841 or 851. In certain such embodiments, a short antisense compound targeted to nucleotides 63207-63222 of SEQ ID NO: 11 is selected from Isis No 147062 or 147066.

In certain embodiments, a target region is nucleotides 64538-64550 of SEQ ID NO: 11. In certain embodiments, a short antisense compound is targeted to nucleotides 64538-64550 of SEQ ID NO: 11. In certain such embodiments, a short antisense compound targeted 64538-64550 of comprises a nucleotide sequence selected from SEQ ID NO 849 or 863. In certain such embodiments, a short antisense compound targeted to nucleotides 64538-64550 of SEQ ID NO: 11 is selected from Isis No 147036 or 147037.

In certain embodiments, a target region is nucleotides 64864-64876 of SEQ ID NO: 11. In certain embodiments, a short antisense compound is targeted to nucleotides 64864-64876 of SEQ ID NO: 11. In certain such embodiments, a short antisense compound targeted 64864-64876 of comprises a nucleotide sequence selected from SEQ ID NO 851 or 876. In certain such embodiments, a short antisense compound targeted to nucleotides 64864-64876 of SEQ ID NO: 11 is selected from Isis No 147066 or 147067.

In certain embodiments, a target region is nucleotides 65010-65028 of SEQ ID NO: 11. In certain embodiments, a short antisense compound is targeted to nucleotides 65010-65028 of SEQ ID NO: 11. In certain such embodiments, a short antisense compound targeted 65010-65028 of comprises a nucleotide sequence selected from SEQ ID NO 851, 876, or 883. In certain such embodiments, a short antisense compound targeted to nucleotides 65010-65028 of SEQ ID NO: 11 is selected from Isis No 147066, 147067, or 147045.

In certain embodiments, a target region is nucleotides 65163-65175 of SEQ ID NO: 11. In certain embodiments, a short antisense compound is targeted to nucleotides 65163-65175 of SEQ ID NO: 11. In certain such embodiments, a short antisense compound targeted 65163-65175 of comprises a nucleotide sequence selected from SEQ ID NO 883 or 858. In certain such embodiments, a short antisense compound targeted to nucleotides 65163-65175 of SEQ ID NO: 11 is selected from Isis No 147045 or 147046.

In certain embodiments, a target region is nucleotides 65408-65422 of SEQ ID NO: 11. In certain embodiments, a short antisense compound is targeted to nucleotides 65408-65422 of SEQ ID NO: 11. In certain such embodiments, a short antisense compound targeted 65408-65422 of comprises a nucleotide sequence selected from SEQ ID NO 883 or 856. In certain such embodiments, a short antisense compound targeted to nucleotides 65408-65422 of SEQ ID NO: 11 is selected from Isis No 147068 or 147071.

In certain embodiments, a target region is nucleotides 65549-65568 of SEQ ID NO: 11. In certain embodiments, a short antisense compound is targeted to nucleotides 65549-65568 of SEQ ID NO: 11. In certain such embodiments, a short antisense compound targeted 65549-65568 of comprises a nucleotide sequence selected from SEQ ID NO 860, 838, or 856. In certain such embodiments, a short antisense compound targeted to nucleotides 65549-65568 of SEQ ID NO: 11 is selected from Isis No 147069, 147068, or 147071.

In certain embodiments, a target region is nucleotides 67741-67754 of SEQ ID NO: 11. In certain embodiments, a short antisense compound is targeted to nucleotides 67741-67754 of SEQ ID NO: 11. In certain such embodiments, a short antisense compound targeted 67741-67754 of comprises a nucleotide sequence selected from SEQ ID NO 848, 874, or 885. In certain such embodiments, a short antisense compound targeted to nucleotides 67741-67754 of SEQ ID NO: 11 is selected from Isis No 147029, 147030, or 147031.

In certain embodiments, a target region is nucleotides 67886-67900 of SEQ ID NO: 11. In certain embodiments, a short antisense compound is targeted to nucleotides 67886-67900 of SEQ ID NO: 11. In certain such embodiments, a short antisense compound targeted 67886-67900 of comprises a nucleotide sequence selected from SEQ ID NO 846, 848, 874, or 885. In certain such embodiments, a short antisense compound targeted to nucleotides 67886-67900 of SEQ ID NO: 11 is selected from Isis No 147028, 147029, 147030, or 147031.

In certain embodiments, a target region is nucleotides 68867-68880 of SEQ ID NO: 11. In certain embodiments, a short antisense compound is targeted to nucleotides 68867-68880 of SEQ ID NO: 11. In certain such embodiments, a short antisense compound targeted 68867-68880 of comprises a nucleotide sequence selected from SEQ ID NO 881, 869, or 883. In certain such embodiments, a short antisense compound targeted to nucleotides 68867-68880 of SEQ ID NO: 11 is selected from Isis No 147043, 147044, or 147045.

In certain embodiments, a target region is nucleotides 69013-69532 of SEQ ID NO: 11. In certain embodiments, a short antisense compound is targeted to nucleotides 69013-69532 of SEQ ID NO: 11. In certain such embodiments, a short antisense compound targeted 69013-69532 of comprises a nucleotide sequence selected from SEQ ID NO 881, 869, 883, 858, 856, 832, or 842. In certain such embodiments, a short antisense compound targeted to nucleotides 69013-69532 of SEQ ID NO: 11 is selected from Isis No 147043, 147044, 147045, 147046, 147071, 147072, or 147073.

In certain embodiments, a target region is nucleotides 69665-69880 of SEQ ID NO: 11. In certain embodiments, a short antisense compound is targeted to nucleotides 69665-69880 of SEQ ID NO: 11. In certain such embodiments, a short antisense compound targeted 69665-69880 of comprises a nucleotide sequence selected from SEQ ID NO 856, 832, 842, 845, or 851. In certain such embodiments, a short antisense compound targeted to nucleotides 69665-69880 of SEQ ID NO: 11 is selected from Isis No 147071, 147072, 147073, 147074, or 147066.

In certain embodiments, a target region is nucleotides 70611-70630 of SEQ ID NO: 11. In certain embodiments, a short antisense compound is targeted to nucleotides 70611-70630 of SEQ ID NO: 11. In certain such embodiments, a short antisense compound targeted 70611-70630 of comprises a nucleotide sequence selected from SEQ ID NO 859, 841, 862, 880, 857, or 851. In certain such embodiments, a short antisense compound targeted to nucleotides 70611-70630 of SEQ ID NO: 11 is selected from Isis No 147023, 147062, 147063, 147064, 147065, or 147066.

In certain embodiments, a target region is nucleotides 70762-70776 of SEQ ID NO: 11. In certain embodiments, a short antisense compound is targeted to nucleotides 70762-70776 of SEQ ID NO: 11. In certain such embodiments, a short antisense compound targeted 70762-70776 of comprises a nucleotide sequence selected from SEQ ID NO 862, 880, 857, or 851. In certain such embodiments, a short antisense compound targeted to nucleotides 70762-70776 of SEQ ID NO: 11 is selected from Isis No 147063, 147064, 147065, or 147066.

In certain embodiments, a target region is nucleotides 70998-71010 of SEQ ID NO: 11. In certain embodiments, a short antisense compound is targeted to nucleotides 70998-71010 of SEQ ID NO: 11. In certain such embodiments, a short antisense compound targeted 70998-71010 of comprises a nucleotide sequence selected from SEQ ID NO 832 or 842. In certain such embodiments, a short antisense compound targeted to nucleotides 70998-71010 of SEQ ID NO: 11 is selected from Isis No 147072 or 147073.

In certain embodiments, a target region is nucleotides 71144-714364 of SEQ ID NO: 11. In certain embodiments, a short antisense compound is targeted to nucleotides 71144-714364 of SEQ ID NO: 11. In certain such embodiments, a short antisense compound targeted 71144-714364 of comprises a nucleotide sequence selected from SEQ ID NO 832, 842, 845, 863, 855, or 850. In certain such embodiments, a short antisense compound targeted to nucleotides 71144-

714364 of SEQ ID NO: 11 is selected from Isis No 147072, 147073, 147074, 147037, 147038, or 147039.

In certain embodiments, a target region is nucleotides 71497-71652 of SEQ ID NO: 11. In certain embodiments, a short antisense compound is targeted to nucleotides 71497-71652 of SEQ ID NO: 11. In certain such embodiments, a short antisense compound targeted 71497-71652 of comprises a nucleotide sequence selected from SEQ ID NO 863, 855, 850, or 879. In certain such embodiments, a short antisense compound targeted to nucleotides 71497-71652 of SEQ ID NO: 11 is selected from Isis No 147037, 147038, 147039, or 147061.

In certain embodiments, short antisense compounds targeted to a PTP1B nucleic acid are 8 to 16, preferably 9 to 15, more preferably 9 to 14, more preferably 10 to 14 nucleotides in length. In certain embodiments, short antisense compounds targeted to a PTP1B nucleic acid are 9 to 14 nucleotides in length. In certain embodiments, short antisense compounds targeted to a PTP1B nucleic acid are 10 to 14 nucleotides in length. In certain embodiments, such short antisense compounds are short antisense oligonucleotides.

In certain embodiments, short antisense compounds targeted to a PTP1B nucleic acid are short gapmers. In certain such embodiments, short gapmers targeted to a PTP1B nucleic acid comprise at least one high affinity modification in one or more wings of the compound. In certain embodiments, short antisense compounds targeted to a PTP1B nucleic acid comprise 1 to 3 high-affinity modifications in each wing. In certain such embodiments, the nucleosides or nucleotides of the wing comprise a 2' modification. In certain such embodiments, the monomers of the wing are BNA's. In certain such embodiments, the monomers of the wing are selected from α-L-Methyleneoxy (4'-CH$_2$—O-2') BNA, β-D-Methyleneoxy (4'-CH$_2$—O-2') BNA, Ethyleneoxy (4'-(CH$_2$)$_2$—O-2') BNA, Aminooxy (4'-CH$_2$—O—N(R)-2') BNA and Oxyamino (4'-CH$_2$—N(R)—O-2') BNA. In certain embodiments, the monomers of a wing comprise a substituent at the 2' position selected from allyl, amino, azido, thio, O-allyl, O—C$_1$-C$_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), and O—CH$_2$—C(=O)—N(R$_m$)(R$_n$), where each R$_m$ and R$_n$ is, independently, H or substituted or unsubstituted C$_1$-C$_{10}$ alkyl. In certain embodiments, the monomers of a wing are 2'MOE nucleotides.

In certain embodiments, short antisense compounds targeted to a PTP1B nucleic acid comprise a gap between the 5' wing and the 3' wing. In certain embodiments the gap comprises five, six, seven, eight, nine, ten, eleven, twelve, thirteen, or fourteen monomers. In certain embodiments, the monomers of the gap are unmodified deoxyribonucleotides. In certain embodiments, the monomers of the gap are unmodified ribonucleotides. In certain embodiments, gap modifications (if any) gap result in an antisense compound that, when bound to its target nucleic acid, supports cleavage by an RNase, including, but not limited to, RNase H.

In certain embodiments, short antisense compounds targeted to a PTP1B nucleic acid have uniform monomeric linkages. In certain such embodiments, those linkages are all phosphorothioate linkages. In certain embodiments, the linkages are all phosphodiester linkages. In certain embodiments, short antisense compounds targeted to a PTP1B nucleic acid have mixed backbones.

In certain embodiments, short antisense compounds targeted to a PTP1B nucleic acid are 8 monomers in length. In certain embodiments, short antisense compounds targeted to a PTP1B nucleic acid are 9 monomers in length. In certain embodiments, short antisense compounds targeted to a PTP1B nucleic acid are 10 monomers in length. In certain embodiments, short antisense compounds targeted to a PTP1B nucleic acid are 11 monomers in length. In certain embodiments, short antisense compounds targeted to a PTP1B nucleic acid are monomers in length. In certain embodiments, short antisense compounds targeted to a PTP1B nucleic acid are 13 monomers in length. In certain embodiments, short antisense compounds targeted to a PTP1B nucleic acid are 14 monomers in length. In certain embodiments, short antisense compounds targeted to a PTP1B nucleic acid are 15 monomers in length. In certain embodiments, short antisense compounds targeted to a PTP1B nucleic acid are 16 monomers in length. In certain embodiments, short antisense compounds targeted to a PTP1B nucleic acid comprise 9 to 15 monomers. In certain embodiments, short antisense compounds targeted to a PTP1B nucleic acid comprise 10 to 15 monomers. In certain embodiments, short antisense compounds targeted to a PTP1B nucleic acid comprise 12 to 14 monomers. In certain embodiments, short antisense compounds targeted to a PTP1B nucleic acid comprise 12 to 14 nucleotides or nucleosides.

In certain embodiments, the invention provides methods of modulating expression of PTP1B. In certain embodiments, such methods comprise use of one or more short antisense compound targeted to a PTP1B nucleic acid, wherein the short antisense compound targeted to a PTP1B nucleic acid is from about 8 to about 16, preferably 9 to 15, more preferably 9 to 14, more preferably 10 to 14 monomers (i.e. from about 8 to about 16 linked monomers). One of ordinary skill in the art will appreciate that this comprehends methods of modulating expression of PTP1B using one or more short antisense compounds targeted to a PTP1B nucleic acid of 8, 9, 10, 11, 12, 13, 14, 15 or 16 monomers.

In certain embodiments, methods of modulating PTP1B comprise use of a short antisense compound targeted to a PTP1B nucleic acid that is 8 monomers in length. In certain embodiments, methods of modulating PTP1B comprise use of a short antisense compound targeted to a PTP1B nucleic acid that is 9 monomers in length. In certain embodiments, methods of modulating PTP1B comprise use of a short antisense compound targeted to a PTP1B nucleic acid that is 10 monomers in length. In certain embodiments, methods of modulating PTP1B comprise use of a short antisense compound targeted to a PTP1B nucleic acid that is 11 monomers in length. In certain embodiments, methods of modulating PTP1B comprise use of a short antisense compound targeted to a PTP1B nucleic acid that is 12 monomers in length. In certain embodiments, methods of modulating PTP1B comprise use of a short antisense compound targeted to a PTP1B nucleic acid that is 13 monomers in length. In certain embodiments, methods of modulating PTP1B comprise use of a short antisense compound targeted to a PTP1B nucleic acid that is 14 monomers in length. In certain embodiments, methods of modulating PTP1B comprise use of a short antisense compound targeted to a PTP1B nucleic acid that is 15 monomers in length. In certain embodiments, methods of modulating PTP1B comprise use of a short antisense compound targeted to a PTP1B nucleic acid that is 16 monomers in length.

In certain embodiments, methods of modulating expression of PTP1B comprise use of a short antisense compound targeted to a PTP1B nucleic acid comprising 9 to 15 monomers. In certain embodiments, methods of modulating expression of PTP1B comprise use of a short antisense compound targeted to a PTP1B nucleic acid comprising 10 to 15 monomers. In certain embodiments, methods of modulating expression of PTP1B comprise use of a short antisense compound targeted to a PTP1B nucleic acid comprising 12 to 14 monomers. In certain embodiments, methods of modulating expression of PTP1B comprise use of a short antisense compound targeted to a PTP1B nucleic acid comprising 12 or 14 nucleotides or nucleosides.

10. PTEN

In certain embodiments, the invention provides short antisense compounds targeted to a nucleic acid encoding PTEN. In certain embodiments, such compounds are used to modulate PTEN expression if cells. In certain such embodiments, short antisense compounds targeted to a PTEN nucleic acid are administered to an animal. In certain embodiments, short antisense compounds targeted to a PTEN nucleic acid are useful for studying PTEN, for studying certain nucleases and/or for assessing antisense activity. In certain such embodiments, short antisense compounds targeted to PTEN nucleic acids are useful for assessing certain motifs and/or chemical modifications. In certain embodiments, administration of a short antisense compound targeted to PTEN nucleic acid to an animal results in a measurable phenotypic change.

The short antisense compounds targeting PTEN may have any one or more properties or characteristics of the short antisense compounds generally described herein. In certain embodiments, short antisense compounds targeting a PTP1B nucleic acid have a motif (wing-deoxy gap-wing) selected from 1-12-1, 1-1-10-2, 2-10-1-1, 3-10-3, 2-10-3, 2-10-2, 1-10-1, 1-10-2, 3-8-2, 2-8-2, 1-8-1, 3-6-3 or 1-6-1, more preferably 1-10-1, 2-10-2, 3-10-3, and 1-9-2.

Certain Short Antisense Compounds Targeted to a PTEN Nucleic Acid

In certain embodiments, short antisense compounds are targeted to a PTEN nucleic acid having the sequence of GENBANK® Accession No. NM_000314.4, incorporated herein as SEQ ID NO: 14. In certain embodiments, short antisense compounds are targeted to a PTEN nucleic acid having the sequence of nucleotides 8063255 to 8167140 of the sequence of GENBANK® Accession No. NT_033890.3, incorporated herein as SEQ ID NO: 15. In certain such embodiments, a short antisense compound targeted to SEQ ID NO: 14 is at least 90% complementary to SEQ ID NO: 14. In certain such embodiments, a short antisense compound targeted to SEQ ID NO: 14 is at least 95% complementary to SEQ ID NO: 14. In certain such embodiments, a short antisense compound targeted to SEQ ID NO: 15 is 100% complementary to SEQ ID NO: 15. In certain such embodiments, a short antisense compound targeted to SEQ ID NO: 15 is at least 90% complementary to SEQ ID NO: 15. In certain such embodiments, a short antisense compound targeted to SEQ ID NO: 15 is at least 95% complementary to SEQ ID NO: 15. In certain such embodiments, a short antisense compound targeted to SEQ ID NO: 15 is 100% complementary to SEQ ID NO: 15.

In certain embodiments, a short antisense compound targeted to SEQ ID NO: 14 comprises a nucleotide sequence selected from the nucleotide sequences set forth in Tables 20 and 21. In certain embodiments, a short antisense compound targeted to SEQ ID NO: 15 comprises a nucleotide sequence selected from the nucleotide sequences set forth in Tables 22 and 23.

Each nucleotide sequence set forth in Tables 20, 21, 22, and 23 is independent of any modification to a sugar moiety, an internucleoside linkage, or a nucleobase. As such, short antisense compounds comprising a nucleotide sequence as set forth in Tables 20, 21, 22, and 23 may comprise, independently, one or more modifications to a sugar moiety, an internucleoside linkage, or a nucleobase. Antisense compounds described by Isis Number (Isis NO.) indicate a combination of nucleobase sequence and one or more modifications to a sugar moiety, an internucleoside linkage, or a nucleobase.

Table 20 illustrates short antisense compounds that are 100% complementary to SEQ ID NO: 14. Table 22 illustrates short antisense compounds that are 100% complementary to SEQ ID NO: 15. The column labeled 'gapmer motif' indicates the wing-gap-wing motif of each short antisense compounds. The gap segment comprises 2'-deoxynucleotides and each nucleotide of each wing segment comprises a 2'-modified sugar. The particular 2'-modified sugar is also indicated in the 'gapmer motif' column. For example, '2-10-2 MOE' means a 2-10-2 gapmer motif, where a gap segment of ten 2'-deoxynucleotides is flanked by wing segments of two nucleotides, where the nucleotides of the wing segments are 2'-MOE nucleotides. Internucleoside linkages are phosphorothioate. The short antisense compounds comprise 5-methylcytidine in place of unmodified cytosine, unless "unmodified cytosine" is listed in the gapmer motif column, in which case the indicated cytosines are unmodified cytosines. For example, "5-mC in gap only" indicates that the gap segment has 5-methylcytosines, while the wing segments have unmodified cytosines.

The 2'-modified nucleotides and abbreviations include: 2'-O-methoxyethyl (MOE); 2'-O-methyl (OMe); 2'-O-(2,2,3,3,3-pentafluoropropyl) (PentaF); 2'-O-[(2-methoxy)ethyl]-4'-thio (2'-MOE-4'-thio). (R)-CMOE-BNA. As illustrated in Tables 20 and 22, a wing may comprise monomers comprising more than type of 2' substituent. For example, 1-2-10-2 MOE/PentaF/MOE indicates one MOE-modified nucleotide, followed by two PentaF-modified nucleotides, followed by a gap of ten deoxynucleotides, followed by two PentaF-modified nucleotides. For example, 1-1-10-22'-(butylacetomido)-palmitamide Methyleneoxy BNA/Methyleneoxy BNA indicates that the 5'-most nucleotide is 2'-(butylacetomide)-palmitamide, the second nucleotide is a methyleneoxy BNA nucleotide, and the 3' wing is methyleneoxy BNA. Unless otherwise indicated, cytosines are 5-methylcytosines and internucleoside linkages are phosphorothioate.

TABLE 20

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 390092 | 5530 | 5541 | AGAATGAGACTT | 1-10-1 MOE | 1514 |
| 390091 | 5435 | 5446 | TGAGGCATTATC | 1-10-1 MOE | 1522 |
| 390090 | 5346 | 5357 | AGAGTATCTGAA | 1-10-1 MOE | 1227 |
| 390088 | 5162 | 5173 | CACATTAACAGT | 1-10-1 MOE | 1511 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 390087 | 5126 | 5137 | GTGGCAACCACA | 1-10-1 MOE | 1501 |
| 390085 | 5031 | 5042 | ATTTGATGCTGC | 1-10-1 MOE | 1505 |
| 390084 | 4982 | 4993 | CAAAGAATGGTG | 1-10-1 MOE | 1215 |
| 390082 | 4910 | 4921 | AGGACTTGGGAT | 1-10-1 MOE | 1503 |
| 390080 | 4833 | 4844 | TGCTGCACATCC | 1-10-1 MOE | 1150 |
| 392067 | 4832 | 4845 | CTGCTGCACATCCA | 2-10-2 Methyleneoxy BNA Unmodified cytosines in gap | 1510 |
| 390078 | 4714 | 4725 | CTTTCAGTCATA | 1-10-1 MOE | 1520 |
| 390077 | 4693 | 4704 | GTCAAATTCTAT | 1-10-1 MOE | 1252 |
| 390076 | 4599 | 4610 | TTCCAATGACTA | 1-10-1 MOE | 1506 |
| 390075 | 4576 | 4587 | GTAAGCAAGGCT | 1-10-1 MOE | #N/A |
| 390074 | 4533 | 4544 | ACCCTCATTCAG | 1-10-1 MOE | 1513 |
| 390068 | 4191 | 4202 | GTAAATCCTAAG | 1-10-1 MOE | 1515 |
| 390064 | 4001 | 4012 | ACCACAGCTAGT | 1-10-1 MOE | 1498 |
| 390063 | 3977 | 3988 | CACCAATAAGTT | 1-10-1 MOE | 1219 |
| 390058 | 3828 | 3839 | AGTAGTTGTACT | 1-10-1 MOE | 1192 |
| 390056 | 3793 | 3804 | GGGCATATCAAA | 1-10-1 MOE | 1521 |
| 390054 | 3705 | 3716 | AACACTGCACAT | 1-10-1 MOE | 1493 |
| 390052 | 3623 | 3634 | GACAATTTCTAC | 1-10-1 MOE | 1492 |
| 390050 | 3503 | 3514 | GTATTCAAGTAA | 1-10-1 MOE | 1140 |
| 390049 | 3479 | 3490 | GTTAATGACATT | 1-10-1 MOE | 1491 |
| 390047 | 3428 | 3439 | TGTGTAAGGTCA | 1-10-1 MOE | 1490 |
| 390041 | 3175 | 3186 | TTAGCACTGGCC | 1-10-1 MOE | 1489 |
| 398076 | 3171 | 3182 | CACTGGCCTTGA | 1-10-1 MOE | 1488 |
| 398009 | 3170 | 3183 | GCACTGGCCTTGAT | 2-10-2 MOE | 1487 |
| 398075 | 3111 | 3122 | AAATCATTGTCA | 1-10-1 MOE | 1233 |
| 398008 | 3110 | 3123 | TAAATCATTGTCAA | 2-10-2 MOE | 1486 |
| 398074 | 2913 | 2924 | GCACCAATATGC | 1-10-1 MOE | 1248 |
| 398007 | 2912 | 2925 | AGCACCAATATGCT | 2-10-2 MOE | 1247 |
| 398073 | 2681 | 2692 | TTAGCCAACTGC | 1-10-1 MOE | 1485 |
| 398006 | 2680 | 2693 | CTTAGCCAACTGCA | 2-10-2 MOE | 1484 |
| 390033 | 2679 | 2690 | AGCCAACTGCAA | 1-10-1 MOE | 1483 |
| 398072 | 2671 | 2682 | GCAAACTTATCT | 1-10-1 MOE | 1482 |
| 398005 | 2670 | 2683 | TGCAAACTTATCTG | 2-10-2 MOE | 1481 |
| 390030 | 2534 | 2545 | TTTATAAAACTG | 1-10-1 MOE | 1074 |
| 398071 | 2533 | 2544 | TTATAAAACTGG | 1-10-1 MOE | 1480 |
| 398004 | 2532 | 2545 | TTTATAAAACTGGA | 2-10-2 MOE | 1479 |
| 390029 | 2510 | 2521 | AAAGTGCCATCT | 1-10-1 MOE | 1478 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 390028 | 2491 | 2502 | TCCTAATTGAAT | 1-10-1 MOE | 1477 |
| 398070 | 2481 | 2492 | ATTTTAAATGTC | 1-10-1 MOE | 1476 |
| 398003 | 2480 | 2493 | AATTTTAAATGTCC | 2-10-2 MOE | 1475 |
| 390027 | 2455 | 2466 | AGGTATATACAT | 1-10-1 MOE | 1206 |
| 398069 | 2451 | 2462 | ATATACATGACA | 1-10-1 MOE | 1474 |
| 398002 | 2450 | 2463 | TATATACATGACAC | 2-10-2 MOE | 1473 |
| 398068 | 2440 | 2451 | ACAGCTACACAA | 1-10-1 MOE | 1472 |
| 398001 | 2439 | 2452 | CACAGCTACACAAC | 2-10-2 MOE | 1471 |
| 390026 | 2438 | 2449 | AGCTACACAACC | 1-10-1 MOE | 1470 |
| 390025 | 2406 | 2417 | GTGTCAAAACCC | 1-10-1 MOE | 1211 |
| 398067 | 2405 | 2416 | TGTCAAAACCCT | 1-10-1 MOE | 1210 |
| 398000 | 2404 | 2417 | GTGTCAAAACCCTG | 2-10-2 MOE | 1469 |
| 398066 | 2372 | 2383 | AGATTGGTCAGG | 1-10-1 MOE | 1468 |
| 397999 | 2371 | 2384 | AAGATTGGTCAGGA | 2-10-2 MOE | 1467 |
| 398065 | 2349 | 2360 | GTTCCTATAACT | 1-10-1 MOE | 1466 |
| 397998 | 2348 | 2361 | TGTTCCTATAACTG | 2-10-2 MOE | 1465 |
| 398064 | 2331 | 2342 | CTGACACAATGT | 1-10-1 MOE | 1464 |
| 397997 | 2330 | 2343 | TCTGACACAATGTC | 2-10-2 MOE | 1463 |
| 398063 | 2321 | 2332 | GTCCTATTGCCA | 1-10-1 MOE | 1205 |
| 397996 | 2320 | 2333 | TGTCCTATTGCCAT | 2-10-2 MOE | 1462 |
| 390022 | 2286 | 2297 | CAGTTTATTCAA | 1-10-1 MOE | 1142 |
| 336221 | 2230 | 2243 | TCAGACTTTTGTAA | 3-8-3 MOE | 1461 |
| 336220 | 2224 | 2237 | TTTTGTAATTTGTG | 3-8-3 MOE | 1460 |
| 336219 | 2209 | 2222 | ATGCTGATCTTCAT | 3-8-3 MOE | 1459 |
| 390021 | 2203 | 2214 | CTTCATCAAAAG | 1-10-1 MOE | 1458 |
| 336218 | 2201 | 2214 | CTTCATCAAAAGGT | 3-8-3 MOE | 1457 |
| 389779 | 2201 | 2212 | TCATCAAAAGGT | 1-9-2 MOE | 1176 |
| 389979 | 2201 | 2212 | TCATCAAAAGGT | 1-10-1 MOE | 1176 |
| 397995 | 2200 | 2213 | TTGATCAAAAGGTT | 2-10-2 MOE | 1456 |
| 336217 | 2192 | 2205 | AAGGTTCATTCTCT | 3-8-3 MOE | 1455 |
| 390020 | 2183 | 2194 | TCTGGATCAGAG | 1-10-1 MOE | 1149 |
| 336216 | 2182 | 2195 | CTCTGGATCAGAGT | 3-8-3 MOE | 1454 |
| 336215 | 2169 | 2182 | TCAGTGGTGTCAGA | 3-8-3 MOE | 1453 |
| 398062 | 2166 | 2177 | GGTGTCAGAATA | 1-10-1 MOE | 1255 |
| 397994 | 2165 | 2178 | TGGTGTCAGAATAT | 2-10-2 MOE | 1452 |
| 390019 | 2163 | 2174 | GTCAGAATATCT | 1-10-1 MOE | 1173 |
| 336214 | 2157 | 2170 | GAATATCTATAATG | 3-8-3 MOE | 1573 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 398061 | 2151 | 2162 | ATAATGATCAGG | 1-10-1 MOE | 1451 |
| 397993 | 2150 | 2163 | TATAATGATCAGGT | 2-10-2 MOE | 1450 |
| 336213 | 2146 | 2159 | ATGATCAGGTTCAT | 3-8-3 MOE | 1449 |
| 389778 | 2144 | 2155 | TCAGGTTCATTG | 1-9-2 MOE | 1448 |
| 389978 | 2144 | 2155 | TCAGGTTCATTG | 1-10-1 MOE | 1448 |
| 398060 | 2137 | 2148 | CATTGTCACTAA | 1-10-1 MOE | 1447 |
| 336212 | 2136 | 2149 | TCATTGTCACTAAC | 3-8-3 MOE | 1446 |
| 397992 | 2136 | 2149 | TCATTGTCACTAAC | 2-10-2 MOE | 1446 |
| 336211 | 2112 | 2125 | ACAGAAGTTGAACT | 3-8-3 MOE | 1445 |
| 390017 | 2111 | 2122 | GAAGTTGAACTG | 1-10-1 MOE | 1444 |
| 398059 | 2108 | 2119 | GTTGAACTGCTA | 1-10-1 MOE | 1443 |
| 397991 | 2107 | 2120 | AGTTGAACTGCTAG | 2-10-2 MOE | 1442 |
| 336210 | 2104 | 2117 | TGAACTGCTAGCCT | 3-8-3 MOE | 1441 |
| 335340 | 2104 | 2118 | TTGAACTGCTAGCCT | 1-10-4 MOE | 1440 |
| 335339 | 2103 | 2117 | TGAACTGCTAGCCTC | 1-10-4 MOE | 1439 |
| 335338 | 2102 | 2116 | GAACTGCTAGCCTCT | 1-10-4 MOE | 1438 |
| 335337 | 2101 | 2115 | AACTGCTAGCCTCTG | 1-10-4 MOE | 1437 |
| 335336 | 2100 | 2114 | ACTGCTAGCCTCTGG | 1-10-4 MOE | 1436 |
| 390430 | 2099 | 2111 | GCTAGCCTCTGGA | 1-10-2 MOE Unmodified cytosines | 1163 |
| 390431 | 2099 | 2111 | GCTAGCCTCTGGA | 1-10-2 MOE Unmodified cytosines C in wing 9-(aminoethoxy)phenoxazine | 1163 |
| 390432 | 2099 | 2111 | GCTAGCCTCTGGA | 1-10-2 MOE | 1163 |
| 390433 | 2099 | 2111 | GCTAGCCTCTGGA | 1-10-2 MOE Unmodified cytosines Nt 6 is 9-(aminoethoxy)phenoxazine | 1163 |
| 390434 | 2099 | 2111 | GCTAGCCTCTGGA | 1-10-2 MOE Unmodified cytosines Nt 7 is 9-(aminoethoxy)phenoxazine | 1163 |
| 390435 | 2099 | 2111 | GCTAGCCTCTGGA | 1-10-2 MOE Unmodified cytosines Nt 9 is 9-(aminoethoxy)phenoxazine | 1163 |
| 335335 | 2099 | 2113 | CTGCTAGCCTCTGGA | 1-10-4 MOE | 1435 |
| 389777 | 2098 | 2109 | TAGCCTCTGGAT | 1-9-2 MOE | 1434 |
| 389954 | 2098 | 2109 | TAGCCTCTGGAT | 1-10-1 MOE | 1434 |
| 335334 | 2098 | 2112 | TGCTAGCCTCTGGAT | 1-10-4 MOE | 1433 |
| 331429 | 2097 | 2110 | CTAGCCTCTGGATT | 2-10-2 MOE | 1431 |
| 335349 | 2097 | 2110 | CTAGCCTCTGGATT | 2-10-2 MOE | 1431 |
| 335367 | 2097 | 2110 | CTAGCCTCTGGATT | 2-10-2 Methyleneoxy BNA | 1431 |
| 335378 | 2097 | 2110 | CTAGCCTCTGGATT | 2-10-2 Methyleneoxy BNA | 1431 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 392061 | 2097 | 2110 | CTAGCCTCTGGATT | 2-10-2 Methyleneoxy BNA Unmodified cytosines in gap | 1431 |
| 383991 | 2097 | 2109 | TAGCCTCTGGATT | 1-10-2 2'-(acetylamino-butyl-acetamido)-cholesterol/MOE | 1432 |
| 383992 | 2097 | 2109 | TAGCCTCTGGATT | 1-10-2 2'-(acetylamino-butyl-acetamido)-cholic acid/MOE | 1432 |
| 386970 | 2097 | 2109 | TAGCCTCTGGATT | 1-10-2 MOE | 1432 |
| 390578 | 2097 | 2109 | TAGCCTCTGGATT | 1-10-2 MOE Unmodified cytosines Ts in wings are 2-thiothymines | 1432 |
| 390614 | 2097 | 2109 | TAGCCTCTGGATT | 1-10-2 PentaF | 1432 |
| 335333 | 2097 | 2111 | GCTAGCCTCTGGATT | 1-10-4 MOE | 1430 |
| 386683 | 2097 | 2109 | TAGCCTCTGGATT | 1-10-2 2'-(butylacetamido)-palmitamide/MOE | 1432 |
| 371975 | 2096 | 2110 | CTAGCCTCTGGATTT | 3-10-2 MOE | 1429 |
| 335341 | 2096 | 2111 | GCTAGCCTCTGGATTT | 3-10-3 MOE | 1428 |
| 335350 | 2096 | 2111 | GCTAGCCTCTGGATTT | 3-10-3 MOE | 1428 |
| 335368 | 2096 | 2111 | GCTAGCCTCTGGATTT | 3-10-3 Methyleneoxy BNA Phosphodiester linkages in wings | 1428 |
| 335379 | 2096 | 2111 | GCTAGCCTCTGGATTT | 3-10-3 Methyleneoxy BNA | 1428 |
| 383739 | 2096 | 2111 | GCTAGCCTCTGGATTT | 3-10-3 MOE 5-methylcytosine in gap | 1428 |
| 384071 | 2096 | 2111 | GCTAGCCTCTGGATTT | 3-10-3 OMe 5-methylcytosine in gap | 1428 |
| 384073 | 2096 | 2111 | GCTAGCCTCTGGATTT | 3-10-3 Methyleneoxy BNA 5-methylcytosine in gap | 1428 |
| 390576 | 2096 | 2111 | GCTAGCCTCTGGATTT | 3-10-3 MOE 5-methylcytosine in gap T's in wings are 2-thiothymines | 1428 |
| 390580 | 2096 | 2111 | GCTAGCCTCTGGATTT | 3-10-3 MOE Pyrimidines in wings are 5-thiazole Unmodified cytosines in gap | 1428 |
| 390581 | 2096 | 2111 | GCTAGCCTCTGGATTT | 3-10-3 MOE Unmodified cytosines in gap | 1428 |
| 391863 | 2096 | 2111 | GCTAGCCTCTGGATTT | 3-10-3 MOE Unmodified cytosines | 1428 |
| 391864 | 2096 | 2111 | GCTAGCCTCTGGATTT | 3-10-3 Methyleneoxy BNA Unmodified cytosines in gap | 1428 |
| 391865 | 2096 | 2111 | GCTAGCCTCTGGATTT | 3-10-3 Methyleneoxy BNA Unmodified cytosines | 1428 |
| 375560 | 2096 | 2110 | CTAGCCTCTGGATTT | 2-10-3 MOE | 1429 |
| 391172 | 2096 | 2110 | CTAGCCTCTGGATTT | 2-10-2 Methyleneoxy BNA Unmodified cytosines | 1429 |
| 391175 | 2096 | 2110 | CTAGCCTCTGGATTT | 2-10-3 Methyleneoxy BNA | 1429 |
| 391449 | 2096 | 2110 | CTAGCCTCTGGATTT | 2-10-3 MOE Unmodified cytosines | 1429 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 392054 | 2096 | 2110 | CTAGCCTCTGGATTT | 2-10-3 Methyleneoxy BNA<br>Unmodified cytosines in gap | 1429 |
| 392055 | 2096 | 2110 | CTAGCCTCTGGATTT | 2-10-3 MOE<br>Unmodified cytosines in gap | 1429 |
| 362977 | 2096 | 2111 | GCTAGCCTCTGGATTT | 2-12-2 MOE | 1428 |
| 386770 | 2096 | 2109 | TAGCCTCTGGATTT | 1-11-2 MOE | 1427 |
| 390577 | 2096 | 2109 | TAGCCTCTGGATTT | 1-10-3 MOE<br>Unmodified cytosines<br>T's in wings are 2-thiothymines | 1427 |
| 335332 | 2096 | 2110 | CTAGCCTCTGGATTT | 1-10-4 MOE | 1429 |
| 390579 | 2096 | 2111 | GCTAGCCTCTGGATTT | 1-1-1-10-3 MOE/4'-thio/2'-O-[(2-methoxy)ethyl]-4'-thio/2'-O-[(2-methoxy)ethyl]-4'-thio<br>Unmodified cytosines in wings<br>Phosphorodiester linkage in wings | 1428 |
| 391173 | 2096 | 2110 | CTAGCCTCTGGATTT | 2-10-3 (5'R)-5'-methyl-Methyleneoxy BNA<br>Unmodified cytosines | 1429 |
| 391174 | 2096 | 2110 | CTAGCCTCTGGATTT | 2-10-3 (5'S)-5'-methyl-Methyleneoxy BNA<br>Unmodified cytosines | 1429 |
| 390607 | 2096 | 2111 | GCTAGCCTCTGGATTT | 3-10-3 MOE/pentaF<br>Unmodified cytosines in wing | 1428 |
| 390609 | 2096 | 2111 | GCTAGCCTCTGGATTT | 3-10-2-1 MOE/MOE/pentaF<br>Unmodified cytosines in wing | 1428 |
| 384072 | 2096 | 2111 | GCTAGCCTCTGGATTT | 1-2-10-3 MOE/pentaF/pentaF<br>Unmodified cytosines in wings | 1428 |
| 390606 | 2096 | 2111 | GCTAGCCTCTGGATTT | 1-2-10-3 MOE/pentaF/pentaF<br>Unmodified cytosines in wing | 1428 |
| 390608 | 2096 | 2111 | GCTAGCCTCTGGATTT | 1-2-10-3 MOE/pentaF/pentaF<br>Unmodified cytosines in wing | 1428 |
| 391869 | 2096 | 2111 | GCTAGCCTCTGGATTT | 1-2-10-3 Methyleneoxy BNA/(5'S)-5'-methyl-Methyleneoxy BNA/(5'S)-5'-methyl-Methyleneoxy BNA<br>Unmodified cytosines | 1428 |
| 385036 | 2096 | 2111 | GCTAGCCTCTGGATTT | 1-2-10-3 OMe/2'-O-methyl-4'-thio/2'-O-methyl-4'-thio<br>Unmodified cytosines in wing | 1428 |
| 385871 | 2096 | 2111 | GCTAGCCTCTGGATTT | 1-2-10-3 OMe/2'-O-[(2-methoxy)ethyl]-4'-thio/2'-O-[(2-methoxy)ethyl]-4'-thio<br>Unmodified cytosines in wing | 1428 |
| 386682 | 2096 | 2111 | GCTAGCCTCTGGATTT | 1-2-10-3 2'-(butylacetamido)-palmitamide/MOE/MOE | 1428 |
| 390582 | 2096 | 2111 | GCTAGCCTCTGGATTT | 1-2-10-3 MOE/2'-O-[(2-methoxy)ethyl]-4'-thio/2'-O-[(2-methoxy)ethyl]-4'-thio<br>Unmodified cytosines in wings<br>Phosphodiester linkage in wings | 1428 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 391868 | 2096 | 2111 | GCTAGCCTCTGGATTT | 1-2-10-3 (5'R)-5'-methyl-Methyleneoxy BNA/Methyleneoxy BNA/(5'R)-5'-methyl-Methyleneoxy BNA Unmodified cytosines | 1428 |
| 336209 | 2095 | 2108 | AGCCTCTGGATTTG | 3-8-3 MOE | 1425 |
| 335331 | 2095 | 2109 | TAGCCTCTGGATTTG | 1-10-4 MOE | 1426 |
| 335376 | 2095 | 2109 | TAGCCTCTGGATTTG | 1-10-4 Methyleneoxy BNA | 1426 |
| 335377 | 2095 | 2109 | TAGCCTCTGGATTTG | 1-10-4 Methyleneoxy BNA Phosphodiester in 3' wing | 1426 |
| 335330 | 2094 | 2108 | AGCCTCTGGATTTGA | 1-10-4 MOE | 1424 |
| 336208 | 2079 | 2092 | GGCTCCTCTACTGT | 3-8-3 MOE | 1423 |
| 336207 | 2073 | 2086 | TCTACTGTTTTTGT | 3-8-3 MOE | 1422 |
| 336206 | 2047 | 2060 | CACCTTAAAATTTG | 3-8-3 MOE | 1518 |
| 389776 | 2046 | 2057 | CTTAAAATTTGG | 1-9-2 MOE | 1421 |
| 389977 | 2046 | 2057 | CTTAAAATTTGG | 1-10-1 MOE | 1421 |
| 397990 | 2045 | 2058 | CCTTAAAATTTGGA | 2-10-2 MOE | 1420 |
| 336205 | 2043 | 2056 | TTAAAATTTGGAGA | 3-8-3 MOE | 1419 |
| 398058 | 2029 | 2040 | AGTATCGGTTGG | 1-10-1 MOE | 1418 |
| 336204 | 2028 | 2041 | AAGTATCGGTTGGC | 3-8-3 MOE | 1417 |
| 397989 | 2028 | 2041 | AAGTATCGGTTGGC | 2-10-2 MOE | 1417 |
| 336203 | 2002 | 2015 | TGCTTTGTCAAGAT | 3-8-3 MOE | 1416 |
| 389775 | 2002 | 2013 | CTTTGTCAAGAT | 1-9-2 MOE | 1177 |
| 389976 | 2002 | 2013 | CTTTGTCAAGAT | 1-10-1 MOE | 1177 |
| 397988 | 2001 | 2014 | GCTTTGTCAAGATC | 2-10-2 MOE | 1415 |
| 336202 | 1959 | 1972 | TCCTTGTCATTATC | 3-8-3 MOE | 1414 |
| 389774 | 1945 | 1956 | CACGCTCTATAC | 1-9-2 MOE | 1413 |
| 389975 | 1945 | 1956 | CACGCTCTATAC | 1-10-1 MOE | 1413 |
| 336201 | 1944 | 1957 | GCACGCTCTATACT | 3-8-3 MOE | 1412 |
| 336200 | 1929 | 1942 | CAAATGCTATCGAT | 3-8-3 MOE | 1411 |
| 389773 | 1904 | 1915 | AGACTTCCATTT | 1-9-2 MOE | 1410 |
| 389974 | 1904 | 1915 | AGACTTCCATTT | 1-10-1 MOE | 1410 |
| 336199 | 1902 | 1915 | AGACTTCCATTTTC | 3-8-3 MOE | 1409 |
| 336198 | 1884 | 1897 | TTTTCTGAGGTTTC | 3-8-3 MOE | 1408 |
| 398057 | 1878 | 1889 | GGTTTCCTCTGG | 1-10-1 MOE | 1407 |
| 397987 | 1877 | 1890 | AGGTTTCCTCTGGT | 2-10-2 MOE | 1406 |
| 336197 | 1873 | 1886 | TTCCTCTGGTCCTG | 3-8-3 MOE | 1405 |
| 390015 | 1868 | 1879 | GGTCCTGGTATG | 1-10-1 MOE | 1404 |
| 398056 | 1865 | 1876 | CCTGGTATGAAG | 1-10-1 MOE | 1403 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 336196 | 1864 | 1877 | TCCTGGTATGAAGA | 3-8-3 MOE | 1402 |
| 397986 | 1864 | 1877 | TCCTGGTATGAAGA | 2-10-2 MOE | 1402 |
| 398055 | 1849 | 1860 | TATTTACCCAAA | 1-10-1 MOE | 1401 |
| 397985 | 1848 | 1861 | GTATTTACCCAAAA | 2-10-2 MOE | 1400 |
| 336195 | 1847 | 1860 | TATTTACCCAAAAG | 3-8-3 MOE | 1399 |
| 389772 | 1846 | 1857 | TTACCCAAAAGT | 1-9-2 MOE | 1398 |
| 389973 | 1846 | 1857 | TTACCCAAAAGT | 1-10-1 MOE | 1398 |
| 336194 | 1838 | 1851 | AAAAGTGAAACATT | 3-8-3 MOE | 1145 |
| 398054 | 1836 | 1847 | GTGAAACATTTT | 1-10-1 MOE | 1144 |
| 397984 | 1835 | 1848 | AGTGAAACATTTTG | 2-10-2 MOE | 1397 |
| 336193 | 1828 | 1841 | CATTTTGTCCTTTT | 3-8-3 MOE | 1182 |
| 336192 | 1810 | 1823 | CATCTTGTTCTGTT | 3-8-3 MOE | 1396 |
| 336191 | 1800 | 1813 | TGTTTGTGGAAGAA | 3-8-3 MOE | 1395 |
| 398053 | 1796 | 1807 | TGGAAGAACTCT | 1-10-1 MOE | 1394 |
| 397983 | 1795 | 1808 | GTGGAAGAACTCTA | 2-10-2 MOE | 1393 |
| 389771 | 1794 | 1805 | GAAGAACTCTAC | 1-9-2 MOE | 1392 |
| 389972 | 1794 | 1805 | GAAGAACTCTAC | 1-10-1 MOE | 1392 |
| 336190 | 1789 | 1802 | GAACTCTACTTTGA | 3-8-3 MOE | 1391 |
| 336189 | 1773 | 1786 | TCACCACACACAGG | 3-8-3 MOE | 1390 |
| 336188 | 1754 | 1767 | GCTGAGGGAACTCA | 3-8-3 MOE | 1389 |
| 398052 | 1751 | 1762 | GGGAACTCAAAG | 1-10-1 MOE | 1388 |
| 389770 | 1750 | 1761 | GGAACTCAAAGT | 1-9-2 MOE | 1386 |
| 389971 | 1750 | 1761 | GGAACTCAAAGT | 1-10-1 MOE | 1386 |
| 397982 | 1750 | 1763 | AGGGAACTCAAAGT | 2-10-2 MOE | 1387 |
| 336187 | 1747 | 1760 | GAACTCAAAGTACA | 3-8-3 MOE | 1385 |
| 390012 | 1745 | 1756 | TCAAAGTACATG | 1-10-1 MOE | 1384 |
| 336186 | 1688 | 1701 | TCTTCACCTTTAGC | 3-8-3 MOE | 1383 |
| 398051 | 1684 | 1695 | CCTTTAGCTGGC | 1-10-1 MOE | 1220 |
| 397981 | 1683 | 1696 | ACCTTTAGCTGGCA | 2-10-2 MOE | 1382 |
| 336185 | 1677 | 1690 | AGCTGGCAGACCAC | 3-8-3 MOE | 1381 |
| 389769 | 1676 | 1687 | TGGCAGACCACA | 1-9-2 MOE | 1249 |
| 389970 | 1676 | 1687 | TGGCAGACCACA | 1-10-1 MOE | 1249 |
| 392060 | 1675 | 1688 | CTGGCAGACCACAA | 2-10-2 Methyleneoxy BNA Unmodified cytosines in gap | 1380 |
| 398050 | 1672 | 1683 | AGACCACAAACT | 1-10-1 MOE | 1379 |
| 397980 | 1671 | 1684 | CAGACCACAAACTG | 2-10-2 MOE | 1378 |
| 390011 | 1658 | 1669 | GGATTGCAAGTT | 1-10-1 MOE | 1238 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 336184 | 1655 | 1668 | GATTGCAAGTTCCG | 3-8-3 MOE | 1508 |
| 336183 | 1644 | 1657 | CCGCCACTGAACAT | 3-8-3 MOE | 1377 |
| 390010 | 1643 | 1654 | CCACTGAACATT | 1-10-1 MOE | 1240 |
| 398049 | 1641 | 1652 | ACTGAACATTGG | 1-10-1 MOE | 1376 |
| 397979 | 1640 | 1653 | CACTGAACATTGGA | 2-10-2 MOE | 1375 |
| 336182 | 1633 | 1646 | CATTGGAATAGTTT | 3-8-3 MOE | 1374 |
| 389768 | 1630 | 1641 | GAATAGTTTCAA | 1-9-2 MOE | 1373 |
| 389969 | 1630 | 1641 | GAATAGTTTCAA | 1-10-1 MOE | 1373 |
| 398048 | 1626 | 1637 | AGTTTCAAACAT | 1-10-1 MOE | 1372 |
| 397978 | 1625 | 1638 | TAGTTTCAAACATC | 2-10-2 MOE | 1371 |
| 336181 | 1623 | 1636 | GTTTCAAACATCAT | 3-8-3 MOE | 1370 |
| 398047 | 1614 | 1625 | CATCTTGTGAAA | 1-10-1 MOE | 1369 |
| 336180 | 1613 | 1626 | TCATCTTGTGAAAC | 3-8-3 MOE | 1368 |
| 390009 | 1613 | 1624 | ATCTTGTGAAAC | 1-10-1 MOE | 1175 |
| 397977 | 1613 | 1626 | TCATCTTGTGAAAC | 2-10-2 MOE | 1368 |
| 390007 | 1563 | 1574 | CAGGTAGCTATA | 1-10-1 MOE | 1367 |
| 336179 | 1561 | 1574 | CAGGTAGCTATAAT | 3-8-3 MOE | 1366 |
| 336178 | 1541 | 1554 | CATAGCGCCTCTGA | 3-8-3 MOE | 1365 |
| 336177 | 1534 | 1547 | CCTCTGACTGGGAA | 3-8-3 MOE | 1364 |
| 389767 | 1534 | 1545 | TCTGACTGGGAA | 1-9-2 MOE | 1151 |
| 389968 | 1534 | 1545 | TCTGACTGGGAA | 1-10-1 MOE | 1151 |
| 335344 | 1503 | 1516 | TCTCTGGTCCTTAC | 2-10-2 MOE | 1363 |
| 335355 | 1503 | 1516 | TCTCTGGTCCTTAC | 2-10-2 MOE Phosphodiester linkage in wings | 1363 |
| 335370 | 1503 | 1516 | TCTCTGGTCCTTAC | 2-10-2 Methyleneoxy BNA Phosphodiester linkage in wings | 1363 |
| 335381 | 1503 | 1516 | TCTCTGGTCCTTAC | 2-10-2 Methyleneoxy BNA | 1363 |
| 335411 | 1503 | 1516 | TCTCTGGTCCTTAC | 2-10-2 MOE 3' C is 9-(aminoethoxy)phenoxazine | 1363 |
| 335412 | 1503 | 1516 | TCTCTGGTCCTTAC | 2-10-2 MOE C in 5' wing is 9-(aminoethoxy)phenoxazine | 1363 |
| 335413 | 1503 | 1516 | TCTCTGGTCCTTAC | 2-10-2 MOE C in wings are 9-(aminoethoxy)phenoxazine | 1363 |
| 336176 | 1502 | 1515 | CTCTGGTCCTTACT | 3-8-3 MOE | 1361 |
| 335345 | 1502 | 1517 | GTCTCTGGTCCTTACT | 3-10-3 MOE | 1362 |
| 335356 | 1502 | 1517 | GTCTCTGGTCCTTACT | 3-10-3 MOE Phosphodiester linkage in wings | 1362 |
| 335371 | 1502 | 1517 | GTCTCTGGTCCTTACT | 3-10-3 Methyleneoxy BNA Phosphodiester linkage in wings | 1362 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 335382 | 1502 | 1517 | GTCTCTGGTCCTTACT | 3-10-3 Methyleneoxy BNA | 1362 |
| 335414 | 1502 | 1517 | GTCTCTGGTCCTTACT | 3-10-3 MOE C in 3' wing is 9-(aminoethoxy)phenoxazine | 1362 |
| 335415 | 1502 | 1517 | GTCTCTGGTCCTTACT | 3-10-3 MOE C in 5' wing is 9-(aminoethoxy)phenoxazine | 1362 |
| 335416 | 1502 | 1517 | GTCTCTGGTCCTTACT | 3-10-3 MOE C's in wings are 9-(aminoethoxy)phenoxazine | 1362 |
| 336175 | 1495 | 1508 | CCTTACTTCCCCAT | 3-8-3 MOE | 1360 |
| 336174 | 1472 | 1485 | GGGCCTCTTGTGCC | 3-8-3 MOE | 1359 |
| 336173 | 1465 | 1478 | TTGTGCCTTTAAAA | 3-8-3 MOE | 1358 |
| 398046 | 1465 | 1476 | GTGCCTTTAAAA | 1-10-1 MOE | 1199 |
| 389766 | 1464 | 1475 | TGCCTTTAAAAA | 1-9-2 MOE | 1217 |
| 389967 | 1464 | 1475 | TGCCTTTAAAAA | 1-10-1 MOE | 1217 |
| 397976 | 1464 | 1477 | TGTGCCTTTAAAAA | 2-10-2 MOE | 1357 |
| 336172 | 1437 | 1450 | AATAAATATGCACA | 3-8-3 MOE | 1356 |
| 398045 | 1423 | 1434 | TCATTACACCAG | 1-10-1 MOE | 1355 |
| 336171 | 1422 | 1435 | ATCATTACACCAGT | 3-8-3 MOE | 1354 |
| 389765 | 1422 | 1433 | CATTACACCAGT | 1-9-2 MOE | 1353 |
| 389966 | 1422 | 1433 | CATTACACCAGT | 1-10-1 MOE | 1353 |
| 397975 | 1422 | 1435 | ATCATTACACCAGT | 2-10-2 MOE | 1354 |
| 390005 | 1400 | 1411 | CCAGCTTTACAG | 1-10-1 MOE | 1352 |
| 336170 | 1392 | 1405 | TTACAGTGAATTGC | 3-8-3 MOE | 1351 |
| 398044 | 1382 | 1393 | GCTGCAACATGA | 1-10-1 MOE | 1350 |
| 336169 | 1381 | 1394 | TGCTGCAACATGAT | 3-8-3 MOE | 1349 |
| 389764 | 1381 | 1392 | CTGCAACATGAT | 1-9-2 MOE | 1018 |
| 389965 | 1381 | 1392 | CTGCAACATGAT | 1-10-1 MOE | 1018 |
| 397974 | 1381 | 1394 | TGCTGCAACATGAT | 2-10-2 MOE | 1349 |
| 336168 | 1362 | 1375 | TCTTCACTTAGCCA | 3-8-3 MOE | 1348 |
| 390004 | 1362 | 1373 | TTCACTTAGCCA | 1-10-1 MOE | 1208 |
| 336167 | 1353 | 1366 | AGCCATTGGTCAAG | 3-8-3 MOE | 1347 |
| 398043 | 1345 | 1356 | CAAGATCTTCAC | 1-10-1 MOE | 1244 |
| 336166 | 1344 | 1357 | TCAAGATCTTCACA | 3-8-3 MOE | 1346 |
| 390003 | 1344 | 1355 | AAGATCTTCACA | 1-10-1 MOE | 1243 |
| 397973 | 1344 | 1357 | TCAAGATCTTCACA | 2-10-2 MOE | 1346 |
| 336165 | 1329 | 1342 | AAGGGTTTGATAAG | 3-8-3 MOE | 1345 |
| 390002 | 1322 | 1333 | ATAAGTTCTAGC | 1-10-1 MOE | 1344 |
| 336164 | 1318 | 1331 | AAGTTCTAGCTGTG | 3-8-3 MOE | 1343 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 398042 | 1305 | 1316 | TGGGTTATGGTC | 1-10-1 MOE | 1214 |
| 336163 | 1304 | 1317 | GTGGGTTATGGTCT | 3-8-3 MOE | 1342 |
| 397972 | 1304 | 1317 | GTGGGTTATGGTCT | 2-10-2 MOE | 1342 |
| 398089 | 1298 | 1309 | TGGTCTTCAAAA | 1-10-1 MOE | 1341 |
| 389763 | 1296 | 1307 | GTCTTCAAAAGG | 1-9-2 MOE | 1197 |
| 389964 | 1296 | 1307 | GTCTTCAAAAGG | 1-10-1 MOE | 1197 |
| 398041 | 1294 | 1305 | CTTCAAAAGGAT | 1-10-1 MOE | 1196 |
| 336162 | 1293 | 1306 | TCTTCAAAAGGATA | 3-8-3 MOE | 1340 |
| 397971 | 1293 | 1306 | TCTTCAAAAGGATA | 2-10-2 MOE | 1340 |
| 398040 | 1279 | 1290 | GTGCAACTCTGC | 1-10-1 MOE | 1236 |
| 336161 | 1278 | 1291 | TGTGCAACTCTGCA | 3-8-3 MOE | 1235 |
| 397970 | 1278 | 1291 | TGTGCAACTCTGCA | 2-10-2 MOE | 1235 |
| 398039 | 1264 | 1275 | TAAATTTGGCGG | 1-10-1 MOE | 1339 |
| 397969 | 1263 | 1276 | TTAAATTTGGCGGT | 2-10-2 MOE | 1338 |
| 336160 | 1261 | 1274 | AAATTTGGCGGTGT | 3-8-3 MOE | 1337 |
| 336159 | 1253 | 1266 | CGGTGTCATAATGT | 3-8-3 MOE | 1336 |
| 398038 | 1252 | 1263 | TGTCATAATGTC | 1-10-1 MOE | 1200 |
| 390000 | 1251 | 1262 | GTCATAATGTCT | 1-10-1 MOE | 1194 |
| 397968 | 1251 | 1264 | GTGTCATAATGTCT | 2-10-2 MOE | 1195 |
| 336158 | 1227 | 1240 | AGATTGTATATCTT | 3-8-3 MOE | 1335 |
| 389762 | 1220 | 1231 | ATCTTGTAATGG | 1-9-2 MOE | 1334 |
| 389963 | 1220 | 1231 | ATCTTGTAATGG | 1-10-1 MOE | 1334 |
| 336157 | 1215 | 1228 | TTGTAATGGTTTTT | 3-8-3 MOE | 1333 |
| 336156 | 1202 | 1215 | TATGCTTTGAATCC | 3-8-3 MOE | 1332 |
| 389998 | 1199 | 1210 | TTTGAATCCAAA | 1-10-1 MOE | 1331 |
| 397967 | 1198 | 1211 | CTTTGAATCCAAAA | 2-10-2 MOE | 1330 |
| 336155 | 1190 | 1203 | CCAAAAACCTTACT | 3-8-3 MOE | 1500 |
| 336154 | 1176 | 1189 | ACATCATCAATATT | 3-8-3 MOE | 1329 |
| 389761 | 1171 | 1182 | CAATATTGTTCC | 1-9-2 MOE | 1328 |
| 389962 | 1171 | 1182 | CAATATTGTTCC | 1-10-1 MOE | 1328 |
| 398037 | 1170 | 1181 | AATATTGTTCCT | 1-10-1 MOE | 1202 |
| 397966 | 1169 | 1182 | CAATATTGTTCCTG | 2-10-2 MOE | 1327 |
| 336153 | 1164 | 1177 | TTGTTCCTGTATAC | 3-8-3 MOE | 1326 |
| 336152 | 1149 | 1162 | CCTTCAAGTCTTTC | 3-8-3 MOE | 1325 |
| 389996 | 1141 | 1152 | TTTCTGCAGGAA | 1-10-1 MOE | 1165 |
| 336151 | 1138 | 1151 | TTCTGCAGGAAATC | 3-8-3 MOE | 1324 |
| 398036 | 1138 | 1149 | CTGCAGGAAATC | 1-10-1 MOE | 1323 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 397965 | 1137 | 1150 | TCTGCAGGAAATCC | 2-10-2 MOE | 1322 |
| 389760 | 1129 | 1140 | ATCCCATAGCAA | 1-9-2 MOE | 1321 |
| 389961 | 1129 | 1140 | ATCCCATAGCAA | 1-10-1 MOE | 1321 |
| 398035 | 1126 | 1137 | CCATAGCAATAA | 1-10-1 MOE | 1320 |
| 336150 | 1125 | 1138 | CCCATAGCAATAAT | 3-8-3 MOE | 1319 |
| 397964 | 1125 | 1138 | CCCATAGCAATAAT | 2-10-2 MOE | 1319 |
| 336149 | 1110 | 1123 | TTTGGATAAATATA | 3-8-3 MOE | 1496 |
| 389995 | 1106 | 1117 | TAAATATAGGTC | 1-10-1 MOE | 1516 |
| 336148 | 1100 | 1113 | TATAGGTCAAGTCT | 3-8-3 MOE | 1495 |
| 398034 | 1099 | 1110 | AGGTCAAGTCTA | 1-10-1 MOE | 1300 |
| 397963 | 1098 | 1111 | TAGGTCAAGTCTAA | 2-10-2 MOE | 1494 |
| 389994 | 1095 | 1106 | CAAGTCTAAGTC | 1-10-1 MOE | 1299 |
| 336147 | 1090 | 1103 | GTCTAAGTCGAATC | 3-8-3 MOE | 1298 |
| 389993 | 1083 | 1094 | GAATCCATCCTC | 1-10-1 MOE | 1297 |
| 336146 | 1080 | 1093 | AATCCATCCTCTTG | 3-8-3 MOE | 1296 |
| 398033 | 1077 | 1088 | ATCCTCTTGATA | 1-10-1 MOE | 1198 |
| 397962 | 1076 | 1089 | CATCCTCTTGATAT | 2-10-2 MOE | 1295 |
| 336145 | 1070 | 1083 | CTTGATATCTCCTT | 3-8-3 MOE | 1294 |
| 336144 | 1057 | 1070 | TTTGTTTCTGCTAA | 3-8-3 MOE | 1293 |
| 389759 | 1056 | 1067 | GTTTCTGCTAAC | 1-9-2 MOE | 1292 |
| 389960 | 1056 | 1067 | GTTTCTGCTAAC | 1-10-1 MOE | 1292 |
| 392059 | 1055 | 1068 | TGTTTCTGCTAACG | 2-10-2 Methyleneoxy BNA Unmodified cytosines in gap | 1291 |
| 336143 | 1044 | 1057 | ACGATCTCTTTGAT | 3-8-3 MOE | 1290 |
| 398032 | 1038 | 1049 | TTTGATGATGGC | 1-10-1 MOE | 1222 |
| 397961 | 1037 | 1050 | CTTTGATGATGGCT | 2-10-2 MOE | 1289 |
| 389992 | 1036 | 1047 | TGATGATGGCTG | 1-10-1 MOE | 1288 |
| 336142 | 1032 | 1045 | ATGATGGCTGTCAT | 3-8-3 MOE | 1287 |
| 389991 | 1021 | 1032 | TGTCTGGGAGCC | 1-10-1 MOE | 1286 |
| 392058 | 1020 | 1033 | ATGTCTGGGAGCCT | 2-10-2 Methyleneoxy BNA Unmodified cytosines in gap | 1285 |
| 397960 | 1020 | 1033 | ATGTCTGGGAGCCT | 2-10-2 MOE | 1285 |
| 389990 | 1007 | 1018 | TGGCTGAAGAAA | 1-10-1 MOE | 1284 |
| 397959 | 1006 | 1019 | GTGGCTGAAGAAAA | 2-10-2 MOE | 1283 |
| 398031 | 987 | 998 | GAGAGATGGCAG | 1-10-1 MOE | 1282 |
| 397958 | 986 | 999 | AGAGAGATGGCAGA | 2-10-2 MOE | 1281 |
| 389758 | 983 | 994 | GATGGCAGAAGC | 1-9-2 MOE | 1280 |
| 389959 | 983 | 994 | GATGGCAGAAGC | 1-10-1 MOE | 1280 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 398030 | 976 | 987 | GAAGCTGCTGGT | 1-10-1 MOE | 1143 |
| 397957 | 975 | 988 | AGAAGCTGCTGGTG | 2-10-2 MOE | 1279 |
| 389989 | 953 | 964 | TTCTGCAGGATG | 1-10-1 MOE | 1170 |
| 389757 | 941 | 952 | GAAATGGCTCTG | 1-9-2 MOE | 1278 |
| 389958 | 941 | 952 | GAAATGGCTCTG | 1-10-1 MOE | 1278 |
| 397956 | 940 | 953 | GGAAATGGCTCTGG | 2-10-2 MOE | 1277 |
| 398029 | 931 | 942 | TGGACTTGGCGG | 1-10-1 MOE | 1186 |
| 397955 | 930 | 943 | CTGGACTTGGCGGT | 2-10-2 MOE | 1276 |
| 398028 | 914 | 925 | GATGCCCTCGC | 1-10-1 MOE | 1275 |
| 397954 | 913 | 926 | TGATGCCCCTCGCT | 2-10-2 MOE | 1274 |
| 398027 | 883 | 894 | GGACCGCAGCCG | 1-10-1 MOE | 1155 |
| 397953 | 882 | 895 | TGGACCGCAGCCGG | 2-10-2 MOE | 1273 |
| 389756 | 874 | 885 | CCGGGTAATGGC | 1-9-2 MOE | 1272 |
| 389957 | 874 | 885 | CCGGGTAATGGC | 1-10-1 MOE | 1272 |
| 398026 | 867 | 878 | ATGGCTGCTGCG | 1-10-1 MOE | 1160 |
| 397952 | 866 | 879 | AATGGCTGCTGCGG | 2-10-2 MOE | 1271 |
| 389987 | 848 | 859 | CTGGATGGTTGC | 1-10-1 MOE | 1270 |
| 389755 | 806 | 817 | AGAGGCCTGGCA | 1-9-2 MOE | 1269 |
| 389956 | 806 | 817 | AGAGGCCTGGCA | 1-10-1 MOE | 1269 |
| 389985 | 584 | 595 | ATGGTGACAGGC | 1-10-1 MOE | 1268 |
| 398025 | 581 | 592 | GTGACAGGCGAC | 1-10-1 MOE | 1267 |
| 397951 | 580 | 593 | GGTGACAGGCGACT | 2-10-2 MOE | 1266 |
| 389754 | 312 | 323 | TGCTCACAGGCG | 1-9-2 MOE | 1158 |
| 389955 | 312 | 323 | TGCTCACAGGCG | 1-10-1 MOE | 1158 |
| 398024 | 231 | 242 | CAGCGGCTCAAC | 1-10-1 MOE | 1265 |
| 397950 | 230 | 243 | ACAGCGGCTCAACT | 2-10-2 MOE | 1264 |
| 389982 | 205 | 216 | CATGGCTGCAGC | 1-10-1 MOE | 1161 |
| 392056 | 204 | 217 | TCATGGCTGCAGCT | 2-10-2 Methyleneoxy BNA | 1263 |
| 394424 | 204 | 217 | TCATGGCTGCAGCT | 2-10-2 MOE | 1263 |
| 396007 | 204 | 217 | TCATGGCTGCAGCT | 2-10-2 (R)-CMOE BNA Unmodified cytosines | 1263 |
| 396008 | 204 | 217 | TCATGGCTGCAGCT | 2-10-2 (S)-CMOE BNA Unmodified cytosines | 1263 |
| 396009 | 204 | 217 | TCATGGCTGCAGCT | 2-10-2 α-L-methyleneoxy BNA Unmodified cytosines | 1263 |
| 396566 | 204 | 217 | TCATGGCTGCAGCT | 2-10-2 Oxyamino BNA Unmodified cytosines | 1263 |
| 396567 | 204 | 217 | TCATGGCTGCAGCT | 2-10-2 N-Methyl-Oxyamino BNA Unmodified cytosines | 1263 |

TABLE 20-continued

Short Antisense Compounds Targeted to SEQ ID NO: 14

| ISIS No | 5' Target Site | 3' Target Site | Sequence (5'-3') | Gapmer Motif | SEQ ID NO |
|---|---|---|---|---|---|
| 396568 | 204 | 217 | TCATGGCTGCAGCT | 2-10-2 (6R)-6-Methyl Methyleneoxy BNA Unmodified cytosines | 1263 |
| 397913 | 204 | 217 | TCATGGCTGCAGCT | 2-10-2 OMe Unmodified cytosines in gap | 1263 |
| 401974 | 204 | 217 | TCATGGCTGCAGCT | 2-10-2 OMe Unmodified cytosines | 1263 |
| 403737 | 204 | 217 | TCATGGCTGCAGCT | 2-10-2 Methyleneoxy BNA 5-thiazole nucleobases in wings | 1263 |
| 404121 | 204 | 217 | TCATGGCTGCAGCT | 2-10-2 Methyleneoxy BNA 5-methylcytosine in gaps 3' Terminal THF phosphorothioate | 1263 |
| 404228 | 204 | 217 | TCATGGCTGCAGCT | 2-10-2 Methyleneoxy BNA 5-methylcytosinse in gaps 5'-terminal reverse abasic | 1263 |
| 396024 | 204 | 217 | TCATGGCTGCAGCT | 2-10-2 (6'S)-6'-methyl-Methyleneoxy BNA Unmodified cytosines | 1263 |
| 396569 | 204 | 217 | TCATGGCTGCAGCT | 2-10-2 (5'S)-5'-methyl-Methyleneoxy BNA Unmodified cytosines | 1263 |
| 396577 | 204 | 217 | TCATGGCTGCAGCT | 2-10-1-1 Methyleneoxy BNA/Methyleneoxy BNA/2'-(butylacetamido)-palmitamide/Unmodified cytosines in gap | 1263 |
| 396576 | 204 | 217 | TCATGGCTGCAGCT | 1-1-10-2 2'-(butylacetamido)-palmitamide/Methyleneoxy BNA/Methyleneoxy BNA Unmodified cytosines in gap | 1263 |
| 398023 | 191 | 202 | CCGAGAGGAGAG | 1-10-1 MOE | 1262 |
| 397949 | 190 | 203 | TCCGAGAGGAGAGA | 2-10-2 MOE | 1261 |
| 398022 | 126 | 137 | AAGAGTCCCGCC | 1-10-1 MOE | 1260 |
| 397948 | 125 | 138 | AAAGAGTCCCGCCA | 2-10-2 MOE | 1259 |

TABLE 22

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 397948 | 525 | 538 | AAAGAGTCCCGCCA | 2-10-2 MOE | 1259 |
| 398022 | 526 | 537 | AAGAGTCCCGCC | 1-10-1 MOE | 1260 |
| 397949 | 590 | 603 | TCCGAGAGGAGAGA | 2-10-2 MOE | 1261 |
| 398023 | 591 | 602 | CCGAGAGGAGAG | 1-10-1 MOE | 1262 |
| 394424 | 604 | 617 | TCATGGCTGCAGCT | 2-10-2 MOE | 1263 |
| 397913 | 604 | 617 | TCATGGCTGCAGCT | 2-10-2 OMe Unmodified cytosines in gap | 1263 |
| 401974 | 604 | 617 | TCATGGCTGCAGCT | 2-10-2 Ome Unmodified cytosines | 1263 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 403737 | 604 | 617 | TCATGGCTGCAGCT | 2-10-2 Methyleneoxy BNA 5-thiazole nucleobases in wings | 1263 |
| 392056 | 604 | 617 | TCATGGCTGCAGCT | 2-10-2 Methyleneoxy BNA Unmodified cytosines in gap | 1263 |
| 396576 | 604 | 617 | TCATGGCTGCAGCT | 1-1-10-2 2'-(butylacetamido)-palmitamide/Methyleneoxy BNA/Methyleneoxy BNA Unmodified cytosines in gap | 1263 |
| 396577 | 604 | 617 | TCATGGCTGCAGCT | 2-10-1-2 Methyleneoxy BNA/Methyleneoxy BNA/ 2'-(butylacetamido)-palmitamide/ Unmodified cytosines in gap | 1263 |
| 404121 | 604 | 617 | TCATGGCTGCAGCT | 2-10-2 Methyleneoxy BNA 5-methylcytosine in gaps 3' Terminal THF phosphorothioate | 1263 |
| 404228 | 604 | 617 | TCATGGCTGCAGCT | 2-10-2 Methyleneoxy BNA 5-methylcytosinse in gaps 5'-terminal reverse abasic | 1263 |
| 396007 | 604 | 617 | TCATGGCTGCAGCT | 2-10-2 (R)-CMOE BNA Unmodified cytosines | 1263 |
| 396008 | 604 | 617 | TCATGGCTGCAGCT | 2-10-2 (S)-CMOE BNA Unmodified cytosines | 1263 |
| 396009 | 604 | 617 | TCATGGCTGCAGCT | 2-10-2 α-L-methyleneoxy BNA Unmodified cytosines | 1263 |
| 396024 | 604 | 617 | TCATGGCTGCAGCT | 2-10-2 (6'S)-6'-methyl-Methyleneoxy BNA Unmodified cytosines | 1263 |
| 396566 | 604 | 617 | TCATGGCTGCAGCT | 2-10-2 Oxyamino BNA Unmodified cytosines | 1263 |
| 396567 | 604 | 617 | TCATGGCTGCAGCT | 2-10-2 N-Methyl-Oxyamino BNA Unmodified cytosines | 1263 |
| 396568 | 604 | 617 | TCATGGCTGCAGCT | 2-10-2 (6R)-6-Methyl Methyleneoxy BNA Unmodified cytosines | 1263 |
| 396569 | 604 | 617 | TCATGGCTGCAGCT | 2-10-2 (5'S)-5'-methyl-Methyleneoxy BNA Unmodified cytosines | 1263 |
| 389982 | 605 | 616 | CATGGCTGCAGC | 1-10-1 MOE | 1161 |
| 397950 | 630 | 643 | ACAGCGGCTCAACT | 2-10-2 MOE | 1264 |
| 398024 | 631 | 642 | CAGCGGCTCAAC | 1-10-1 MOE | 1265 |
| 389955 | 712 | 723 | TGCTCACAGGCG | 1-10-1 MOE | 1158 |
| 389754 | 712 | 723 | TGCTCACAGGCG | 1-9-2 MOE | 1158 |
| 397951 | 980 | 993 | GGTGACAGGCGACT | 2-10-2 MOE | 1266 |
| 398025 | 981 | 992 | GTGACAGGCGAC | 1-10-1 MOE | 1267 |
| 389985 | 984 | 995 | ATGGTGACAGGC | 1-10-1 MOE | 1268 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 389956 | 1206 | 1217 | AGAGGCCTGGCA | 1-10-1 MOE | 1269 |
| 389755 | 1206 | 1217 | AGAGGCCTGGCA | 1-9-2 MOE | 1269 |
| 389987 | 1248 | 1259 | CTGGATGGTTGC | 1-10-1 MOE | 1270 |
| 397952 | 1266 | 1279 | AATGGCTGCTGCGG | 2-10-2 MOE | 1271 |
| 398026 | 1267 | 1278 | ATGGCTGCTGCG | 1-10-1 MOE | 1160 |
| 389957 | 1274 | 1285 | CCGGGTAATGGC | 1-10-1 MOE | 1272 |
| 389756 | 1274 | 1285 | CCGGGTAATGGC | 1-9-2 MOE | 1272 |
| 397953 | 1282 | 1295 | TGGACCGCAGCCGG | 2-10-2 MOE | 1273 |
| 398027 | 1283 | 1294 | GGACCGCAGCCG | 1-10-1 MOE | 1155 |
| 397954 | 1313 | 1326 | TGATGCCCCTCGCT | 2-10-2 MOE | 1274 |
| 398028 | 1314 | 1325 | GATGCCCCTCGC | 1-10-1 MOE | 1275 |
| 397955 | 1330 | 1343 | CTGGACTTGGCGGT | 2-10-2 MOE | 1276 |
| 398029 | 1331 | 1342 | TGGACTTGGCGG | 1-10-1 MOE | 1186 |
| 397956 | 1340 | 1353 | GGAAATGGCTCTGG | 2-10-2 MOE | 1277 |
| 389958 | 1341 | 1352 | GAAATGGCTCTG | 1-10-1 MOE | 1278 |
| 389757 | 1341 | 1352 | GAAATGGCTCTG | 1-9-2 MOE | 1278 |
| 389989 | 1353 | 1364 | TTCTGCAGGATG | 1-10-1 MOE | 1170 |
| 397957 | 1375 | 1388 | AGAAGCTGCTGGTG | 2-10-2 MOE | 1279 |
| 398030 | 1376 | 1387 | GAAGCTGCTGGT | 1-10-1 MOE | 1143 |
| 389959 | 1383 | 1394 | GATGGCAGAAGC | 1-10-1 MOE | 1280 |
| 389758 | 1383 | 1394 | GATGGCAGAAGC | 1-9-2 MOE | 1280 |
| 397958 | 1386 | 1399 | AGAGAGATGGCAGA | 2-10-2 MOE | 1281 |
| 398031 | 1387 | 1398 | GAGAGATGGCAG | 1-10-1 MOE | 1282 |
| 397959 | 1406 | 1419 | GTGGCTGAAGAAAA | 2-10-2 MOE | 1283 |
| 389990 | 1407 | 1418 | TGGCTGAAGAAA | 1-10-1 MOE | 1284 |
| 397960 | 1420 | 1433 | ATGTCTGGGAGCCT | 2-10-2 MOE | 1285 |
| 392058 | 1420 | 1433 | ATGTCTGGGAGCCT | 2-10-2 Methyleneoxy BNA 5-methylcytosine in wing | 1285 |
| 389991 | 1421 | 1432 | TGTCTGGGAGCC | 1-10-1 MOE | 1286 |
| 336142 | 1432 | 1445 | ATGATGGCTGTCAT | 3-8-3 MOE | 1287 |
| 389992 | 1436 | 1447 | TGATGATGGCTG | 1-10-1 MOE | 1288 |
| 397961 | 1437 | 1450 | CTTTGATGATGGCT | 2-10-2 MOE | 1289 |
| 398032 | 1438 | 1449 | TTTGATGATGGC | 1-10-1 MOE | 1222 |
| 336143 | 1444 | 1457 | ACGATCTCTTTGAT | 3-8-3 MOE | 1290 |
| 392059 | 1455 | 1468 | TGTTTCTGCTAACG | 2-10-2 Methyleneoxy BNA 5-methylcytosine in wing | 1291 |
| 389960 | 1456 | 1467 | GTTTCTGCTAAC | 1-10-1 MOE | 1292 |
| 389759 | 1456 | 1467 | GTTTCTGCTAAC | 1-9-2 MOE | 1292 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 336144 | 1457 | 1470 | TTTGTTTCTGCTAA | 3-8-3 MOE | 1293 |
| 336145 | 1470 | 1483 | CTTGATATCTCCTT | 3-8-3 MOE | 1294 |
| 397962 | 1476 | 1489 | CATCCTCTTGATAT | 2-10-2 MOE | 1295 |
| 398033 | 1477 | 1488 | ATCCTCTTGATA | 1-10-1 MOE | 1198 |
| 336146 | 1480 | 1493 | AATCCATCCTCTTG | 3-8-3 MOE | 1296 |
| 389993 | 1483 | 1494 | GAATCCATCCTC | 1-10-1 MOE | 1297 |
| 336147 | 1490 | 1503 | GTCTAAGTCGAATC | 3-8-3 MOE | 1298 |
| 389994 | 1495 | 1506 | CAAGTCTAAGTC | 1-10-1 MOE | 1299 |
| 398034 | 1499 | 1510 | AGGTCAAGTCTA | 1-10-1 MOE | 1300 |
| 398010 | 1500 | 1513 | TACAGGTCAAGTCT | 2-10-2 MOE | 1166 |
| 398077 | 1501 | 1512 | ACAGGTCAAGTC | 1-10-1 MOE | 1167 |
| 398011 | 1512 | 1525 | CGCAGAAATGGATA | 2-10-2 MOE | 1301 |
| 398078 | 1513 | 1524 | GCAGAAATGGAT | 1-10-1 MOE | 1302 |
| 398012 | 1570 | 1583 | TTCGCATCCGTCTA | 2-10-2 MOE | 1303 |
| 398079 | 1571 | 1582 | TCGCATCCGTCT | 1-10-1 MOE | 1304 |
| 398013 | 1663 | 1676 | CCCTAGGTTGAATA | 2-10-2 MOE | 1305 |
| 398080 | 1664 | 1675 | CCTAGGTTGAAT | 1-10-1 MOE | 1306 |
| 398014 | 2025 | 2038 | GTTATGCAAATCAG | 2-10-2 MOE | 1307 |
| 398081 | 2026 | 2037 | TTATGCAAATCA | 1-10-1 MOE | 1308 |
| 398015 | 2620 | 2633 | TGACTCAGTAAATT | 2-10-2 MOE | 1309 |
| 398082 | 2621 | 2632 | GACTCAGTAAAT | 1-10-1 MOE | 1310 |
| 398016 | 2655 | 2668 | TTAAAATTCTTGGG | 2-10-2 MOE | 1311 |
| 398083 | 2656 | 2667 | TAAAATTCTTGG | 1-10-1 MOE | 1312 |
| 398017 | 2687 | 2700 | CCTAACTTTTAGAC | 2-10-2 MOE | 1313 |
| 398084 | 2688 | 2699 | CTAACTTTTAGA | 1-10-1 MOE | 1314 |
| 398018 | 2745 | 2758 | ACCTGAAACTGCAA | 2-10-2 MOE | 1315 |
| 398085 | 2746 | 2757 | CCTGAAACTGCA | 1-10-1 MOE | 1157 |
| 398019 | 13166 | 13179 | GTGTCAAAACCACT | 2-10-2 MOE | 1316 |
| 398086 | 13167 | 13178 | TGTCAAAACCAC | 1-10-1 MOE | 1204 |
| 398020 | 14675 | 14688 | CCTATTCCCACTGA | 2-10-2 MOE | 1317 |
| 398087 | 14676 | 14687 | CTATTCCCACTG | 1-10-1 MOE | 1318 |
| 390033 | 15351 | 15362 | AGCCAACTGCAA | 1-10-1 MOE | 1483 |
| 398021 | 30985 | 30998 | TTGGATAAATATCT | 2-10-2 MOE | 1168 |
| 398088 | 30986 | 30997 | TGGATAAATATC | 1-10-1 MOE | 1169 |
| 397964 | 31001 | 31014 | CCCATAGCAATAAT | 2-10-2 MOE | 1319 |
| 336150 | 31001 | 31014 | CCCATAGCAATAAT | 3-8-3 MOE | 1319 |
| 398035 | 31002 | 31013 | CCATAGCAATAA | 1-10-1 MOE | 1320 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 389961 | 31005 | 31016 | ATCCCATAGCAA | 1-10-1 MOE | 1321 |
| 389760 | 31005 | 31016 | ATCCCATAGCAA | 1-9-2 MOE | 1321 |
| 397965 | 31013 | 31026 | TCTGCAGGAAATCC | 2-10-2 MOE | 1322 |
| 398036 | 31014 | 31025 | CTGCAGGAAATC | 1-10-1 MOE | 1323 |
| 336151 | 31014 | 31027 | TTCTGCAGGAAATC | 3-8-3 MOE | 1324 |
| 389996 | 31017 | 31028 | TTTCTGCAGGAA | 1-10-1 MOE | 1165 |
| 336152 | 31025 | 31038 | CCTTCAAGTCTTTC | 3-8-3 MOE | 1325 |
| 336153 | 31040 | 31053 | TTGTTCCTGTATAC | 3-8-3 MOE | 1326 |
| 397966 | 31045 | 31058 | CAATATTGTTCCTG | 2-10-2 MOE | 1327 |
| 398037 | 31046 | 31057 | AATATTGTTCCT | 1-10-1 MOE | 1202 |
| 389962 | 31047 | 31058 | CAATATTGTTCC | 1-10-1 MOE | 1328 |
| 389761 | 31047 | 31058 | CAATATTGTTCC | 1-9-2 MOE | 1328 |
| 336154 | 31052 | 31065 | ACATCATCAATATT | 3-8-3 MOE | 1329 |
| 389977 | 31480 | 31491 | CTTAAAATTTGG | 1-10-1 MOE | 1421 |
| 389776 | 31480 | 31491 | CTTAAAATTTGG | 1-9-2 MOE | 1421 |
| 397967 | 62446 | 62459 | CTTTGAATCCAAAA | 2-10-2 MOE | 1330 |
| 389998 | 62447 | 62458 | TTTGAATCCAAA | 1-10-1 MOE | 1331 |
| 336156 | 62450 | 62463 | TATGCTTTGAATCC | 3-8-3 MOE | 1332 |
| 336157 | 62463 | 62476 | TTGTAATGGTTTTT | 3-8-3 MOE | 1333 |
| 389963 | 62468 | 62479 | ATCTTGTAATGG | 1-10-1 MOE | 1334 |
| 389762 | 62468 | 62479 | ATCTTGTAATGG | 1-9-2 MOE | 1334 |
| 336158 | 62475 | 62488 | AGATTGTATATCTT | 3-8-3 MOE | 1335 |
| 390000 | 67987 | 67998 | GTCATAATGTCT | 1-10-1 MOE | 1194 |
| 397968 | 67987 | 68000 | GTGTCATAATGTCT | 2-10-2 MOE | 1195 |
| 398038 | 67988 | 67999 | TGTCATAATGTC | 1-10-1 MOE | 1200 |
| 336159 | 67989 | 68002 | CGGTGTCATAATGT | 3-8-3 MOE | 1336 |
| 336160 | 67997 | 68010 | AAATTTGGCGGTGT | 3-8-3 MOE | 1337 |
| 397969 | 67999 | 68012 | TTAAATTTGGCGGT | 2-10-2 MOE | 1338 |
| 398039 | 68000 | 68011 | TAAATTTGGCGG | 1-10-1 MOE | 1339 |
| 397971 | 69952 | 69965 | TCTTCAAAAGGATA | 2-10-2 MOE | 1340 |
| 336162 | 69952 | 69965 | TCTTCAAAAGGATA | 3-8-3 MOE | 1340 |
| 398041 | 69953 | 69964 | CTTCAAAAGGAT | 1-10-1 MOE | 1196 |
| 389964 | 69955 | 69966 | GTCTTCAAAAGG | 1-10-1 MOE | 1197 |
| 389763 | 69955 | 69966 | GTCTTCAAAAGG | 1-9-2 MOE | 1197 |
| 398089 | 69957 | 69968 | TGGTCTTCAAAA | 1-10-1 MOE | 1341 |
| 397972 | 69963 | 69976 | GTGGGTTATGGTCT | 2-10-2 MOE | 1342 |
| 336163 | 69963 | 69976 | GTGGGTTATGGTCT | 3-8-3 MOE | 1342 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 398042 | 69964 | 69975 | TGGGTTATGGTC | 1-10-1 MOE | 1214 |
| 336164 | 69977 | 69990 | AAGTTCTAGCTGTG | 3-8-3 MOE | 1343 |
| 390002 | 69981 | 69992 | ATAAGTTCTAGC | 1-10-1 MOE | 1344 |
| 336165 | 69988 | 70001 | AAGGGTTTGATAAG | 3-8-3 MOE | 1345 |
| 390003 | 70003 | 70014 | AAGATCTTCACA | 1-10-1 MOE | 1243 |
| 397973 | 70003 | 70016 | TCAAGATCTTCACA | 2-10-2 MOE | 1346 |
| 336166 | 70003 | 70016 | TCAAGATCTTCACA | 3-8-3 MOE | 1346 |
| 398043 | 70004 | 70015 | CAAGATCTTCAC | 1-10-1 MOE | 1244 |
| 336167 | 70012 | 70025 | AGCCATTGGTCAAG | 3-8-3 MOE | 1347 |
| 390004 | 70021 | 70032 | TTCACTTAGCCA | 1-10-1 MOE | 1208 |
| 336168 | 70021 | 70034 | TCTTCACTTAGCCA | 3-8-3 MOE | 1348 |
| 389965 | 70040 | 70051 | CTGCAACATGAT | 1-10-1 MOE | 1018 |
| 389764 | 70040 | 70051 | CTGCAACATGAT | 1-9-2 MOE | 1018 |
| 397974 | 70040 | 70053 | TGCTGCAACATGAT | 2-10-2 MOE | 1349 |
| 336169 | 70040 | 70053 | TGCTGCAACATGAT | 3-8-3 MOE | 1349 |
| 398044 | 70041 | 70052 | GCTGCAACATGA | 1-10-1 MOE | 1350 |
| 336170 | 70051 | 70064 | TTACAGTGAATTGC | 3-8-3 MOE | 1351 |
| 390005 | 70059 | 70070 | CCAGCTTTACAG | 1-10-1 MOE | 1352 |
| 389966 | 70081 | 70092 | CATTACACCAGT | 1-10-1 MOE | 1353 |
| 389765 | 70081 | 70092 | CATTACACCAGT | 1-9-2 MOE | 1353 |
| 397975 | 70081 | 70094 | ATCATTACACCAGT | 2-10-2 MOE | 1354 |
| 336171 | 70081 | 70094 | ATCATTACACCAGT | 3-8-3 MOE | 1354 |
| 398045 | 70082 | 70093 | TCATTACACCAG | 1-10-1 MOE | 1355 |
| 336172 | 70096 | 70109 | AATAAATATGCACA | 3-8-3 MOE | 1356 |
| 389967 | 70123 | 70134 | TGCCTTTAAAAA | 1-10-1 MOE | 1217 |
| 389766 | 70123 | 70134 | TGCCTTTAAAAA | 1-9-2 MOE | 1217 |
| 397976 | 70123 | 70136 | TGTGCCTTTAAAAA | 2-10-2 MOE | 1357 |
| 398046 | 70124 | 70135 | GTGCCTTTAAAA | 1-10-1 MOE | 1199 |
| 336173 | 70124 | 70137 | TTGTGCCTTTAAAA | 3-8-3 MOE | 1358 |
| 336174 | 70131 | 70144 | GGGCCTCTTGTGCC | 3-8-3 MOE | 1359 |
| 336175 | 70154 | 70167 | CCTTACTTCCCCAT | 3-8-3 MOE | 1360 |
| 335345 | 70161 | 70176 | GTCTCTGGTCCTTACT | 3-10-3 MOE | 1362 |
| 335356 | 70161 | 70176 | GTCTCTGGTCCTTACT | 3-10-3 MOE Phosphodiester linkage in wings | 1362 |
| 335414 | 70161 | 70176 | GTCTCTGGTCCTTACT | 3-10-3 MOE C in 3' wing is 9-(aminoethoxy)phenoxazine | 1362 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 335415 | 70161 | 70176 | GTCTCTGGTCCTTACT | 3-10-3 MOE C in 5' wing is 9-(aminoethoxy)phenoxazine | 1362 |
| 335416 | 70161 | 70176 | GTCTCTGGTCCTTACT | 3-10-3 MOE C's in wings are 9-(aminoethoxy)phenoxazine | 1362 |
| 336176 | 70161 | 70174 | CTCTGGTCCTTACT | 3-8-3 MOE | 1361 |
| 335371 | 70161 | 70176 | GTCTCTGGTCCTTACT | 3-10-3 Methyleneoxy BNA Phosphodiester linkage in wings | 1362 |
| 335382 | 70161 | 70176 | GTCTCTGGTCCTTACT | 3-10-3 Methyleneoxy BNA | 1362 |
| 335344 | 70162 | 70175 | TCTCTGGTCCTTAC | 2-10-2 MOE | 1363 |
| 335355 | 70162 | 70175 | TCTCTGGTCCTTAC | 2-10-2 MOE Phosphodiester linkage in wings | 1363 |
| 335411 | 70162 | 70175 | TCTCTGGTCCTTAC | 2-10-2 MOE 3' C is 9-(aminoethoxy)phenoxazine | 1363 |
| 335412 | 70162 | 70175 | TCTCTGGTCCTTAC | 2-10-2 MOE $2^{nd}$ C is 9-(aminoethoxy)phenoxazine | 1363 |
| 335413 | 70162 | 70175 | TCTCTGGTCCTTAC | 2-10-2 MOE $2^{nd}$ and 3' terminal C's are 9-(aminoethoxy)phenoxazine | 1363 |
| 335370 | 70162 | 70175 | TCTCTGGTCCTTAC | 2-10-2 Methyleneoxy BNA Phosphodiester linkage in wings | 1363 |
| 335381 | 70162 | 70175 | TCTCTGGTCCTTAC | 2-10-2 Methyleneoxy BNA | 1363 |
| 398068 | 79799 | 79810 | ACAGCTACACAA | 1-10-1 MOE | 1472 |
| 389968 | 89056 | 89067 | TCTGACTGGGAA | 1-10-1 MOE | 1151 |
| 389767 | 89056 | 89067 | TCTGACTGGGAA | 1-9-2 MOE | 1151 |
| 336177 | 89056 | 89069 | CCTCTGACTGGGAA | 3-8-3 MOE | 1364 |
| 336178 | 89063 | 89076 | CATAGCGCCTCTGA | 3-8-3 MOE | 1365 |
| 336179 | 89083 | 89096 | CAGGTAGCTATAAT | 3-8-3 MOE | 1366 |
| 390007 | 89085 | 89096 | CAGGTAGCTATA | 1-10-1 MOE | 1367 |
| 390009 | 89135 | 89146 | ATCTTGTGAAAC | 1-10-1 MOE | 1175 |
| 397977 | 89135 | 89148 | TCATCTTGTGAAAC | 2-10-2 MOE | 1368 |
| 336180 | 89135 | 89148 | TCATCTTGTGAAAC | 3-8-3 MOE | 1368 |
| 398047 | 89136 | 89147 | CATCTTGTGAAA | 1-10-1 MOE | 1369 |
| 336181 | 89145 | 89158 | GTTTCAAACATCAT | 3-8-3 MOE | 1370 |
| 397978 | 89147 | 89160 | TAGTTTCAAACATC | 2-10-2 MOE | 1371 |
| 398048 | 89148 | 89159 | AGTTTCAAACAT | 1-10-1 MOE | 1372 |
| 389969 | 89152 | 89163 | GAATAGTTTCAA | 1-10-1 MOE | 1373 |
| 389768 | 89152 | 89163 | GAATAGTTTCAA | 1-9-2 MOE | 1373 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 336182 | 89155 | 89168 | CATTGGAATAGTTT | 3-8-3 MOE | 1374 |
| 397979 | 89162 | 89175 | CACTGAACATTGGA | 2-10-2 MOE | 1375 |
| 398049 | 89163 | 89174 | ACTGAACATTGG | 1-10-1 MOE | 1376 |
| 390010 | 89165 | 89176 | CCACTGAACATT | 1-10-1 MOE | 1240 |
| 336183 | 89166 | 89179 | CCGCCACTGAACAT | 3-8-3 MOE | 1377 |
| 397980 | 94786 | 94799 | CAGACCACAAACTG | 2-10-2 MOE | 1378 |
| 398050 | 94787 | 94798 | AGACCACAAACT | 1-10-1 MOE | 1379 |
| 392060 | 94790 | 94803 | CTGGCAGACCACAA | 2-10-2 Methyleneoxy BNA Unmodified cytosines in gap | 1380 |
| 389970 | 94791 | 94802 | TGGCAGACCACA | 1-10-1 MOE | 1249 |
| 389769 | 94791 | 94802 | TGGCAGACCACA | 1-9-2 MOE | 1249 |
| 336185 | 94792 | 94805 | AGCTGGCAGACCAC | 3-8-3 MOE | 1381 |
| 397981 | 94798 | 94811 | ACCTTTAGCTGGCA | 2-10-2 MOE | 1382 |
| 398051 | 94799 | 94810 | CCTTTAGCTGGC | 1-10-1 MOE | 1220 |
| 336186 | 94803 | 94816 | TCTTCACCTTTAGC | 3-8-3 MOE | 1383 |
| 390012 | 94860 | 94871 | TCAAAGTACATG | 1-10-1 MOE | 1384 |
| 336187 | 94862 | 94875 | GAACTCAAAGTACA | 3-8-3 MOE | 1385 |
| 389971 | 94865 | 94876 | GGAACTCAAAGT | 1-10-1 MOE | 1386 |
| 389770 | 94865 | 94876 | GGAACTCAAAGT | 1-9-2 MOE | 1386 |
| 397982 | 94865 | 94878 | AGGGAACTCAAAGT | 2-10-2 MOE | 1387 |
| 398052 | 94866 | 94877 | GGGAACTCAAAG | 1-10-1 MOE | 1388 |
| 336188 | 94869 | 94882 | GCTGAGGGAACTCA | 3-8-3 MOE | 1389 |
| 336189 | 94888 | 94901 | TCACCACACACAGG | 3-8-3 MOE | 1390 |
| 336190 | 94904 | 94917 | GAACTCTACTTTGA | 3-8-3 MOE | 1391 |
| 389972 | 94909 | 94920 | GAAGAACTCTAC | 1-10-1 MOE | 1392 |
| 389771 | 94909 | 94920 | GAAGAACTCTAC | 1-9-2 MOE | 1392 |
| 397983 | 94910 | 94923 | GTGGAAGAACTCTA | 2-10-2 MOE | 1393 |
| 398053 | 94911 | 94922 | TGGAAGAACTCT | 1-10-1 MOE | 1394 |
| 336191 | 94915 | 94928 | TGTTTGTGGAAGAA | 3-8-3 MOE | 1395 |
| 336192 | 94925 | 94938 | CATCTTGTTCTGTT | 3-8-3 MOE | 1396 |
| 397984 | 97824 | 97837 | AGTGAAACATTTTG | 2-10-2 MOE | 1397 |
| 398054 | 97825 | 97836 | GTGAAACATTTT | 1-10-1 MOE | 1144 |
| 336194 | 97827 | 97840 | AAAAGTGAAACATT | 3-8-3 MOE | 1145 |
| 389973 | 97835 | 97846 | TTACCCAAAAGT | 1-10-1 MOE | 1398 |
| 389772 | 97835 | 97846 | TTACCCAAAAGT | 1-9-2 MOE | 1398 |
| 336195 | 97836 | 97849 | TATTTACCCAAAAG | 3-8-3 MOE | 1399 |
| 397985 | 97837 | 97850 | GTATTTACCCAAAA | 2-10-2 MOE | 1400 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 398055 | 97838 | 97849 | TATTTACCCAAA | 1-10-1 MOE | 1401 |
| 397986 | 97853 | 97866 | TCCTGGTATGAAGA | 2-10-2 MOE | 1402 |
| 336196 | 97853 | 97866 | TCCTGGTATGAAGA | 3-8-3 MOE | 1402 |
| 398056 | 97854 | 97865 | CCTGGTATGAAG | 1-10-1 MOE | 1403 |
| 390015 | 97857 | 97868 | GGTCCTGGTATG | 1-10-1 MOE | 1404 |
| 336197 | 97862 | 97875 | TTCCTCTGGTCCTG | 3-8-3 MOE | 1405 |
| 397987 | 97866 | 97879 | AGGTTTCCTCTGGT | 2-10-2 MOE | 1406 |
| 398057 | 97867 | 97878 | GGTTTCCTCTGG | 1-10-1 MOE | 1407 |
| 336198 | 97873 | 97886 | TTTTCTGAGGTTTC | 3-8-3 MOE | 1408 |
| 336199 | 97891 | 97904 | AGACTTCCATTTTC | 3-8-3 MOE | 1409 |
| 389974 | 97893 | 97904 | AGACTTCCATTT | 1-10-1 MOE | 1410 |
| 389773 | 97893 | 97904 | AGACTTCCATTT | 1-9-2 MOE | 1410 |
| 336200 | 97918 | 97931 | CAAATGCTATCGAT | 3-8-3 MOE | 1411 |
| 336201 | 97933 | 97946 | GCACGCTCTATACT | 3-8-3 MOE | 1412 |
| 389975 | 97934 | 97945 | CACGCTCTATAC | 1-10-1 MOE | 1413 |
| 389774 | 97934 | 97945 | CACGCTCTATAC | 1-9-2 MOE | 1413 |
| 336202 | 97948 | 97961 | TCCTTGTCATTATC | 3-8-3 MOE | 1414 |
| 397988 | 97990 | 98003 | GCTTTGTCAAGATC | 2-10-2 MOE | 1415 |
| 389976 | 97991 | 98002 | CTTTGTCAAGAT | 1-10-1 MOE | 1177 |
| 389775 | 97991 | 98002 | CTTTGTCAAGAT | 1-9-2 MOE | 1177 |
| 336203 | 97991 | 98004 | TGCTTTGTCAAGAT | 3-8-3 MOE | 1416 |
| 397989 | 98017 | 98030 | AAGTATCGGTTGGC | 2-10-2 MOE | 1417 |
| 336204 | 98017 | 98030 | AAGTATCGGTTGGC | 3-8-3 MOE | 1417 |
| 398058 | 98018 | 98029 | AGTATCGGTTGG | 1-10-1 MOE | 1418 |
| 336205 | 98032 | 98045 | TTAAAATTTGGAGA | 3-8-3 MOE | 1419 |
| 397990 | 98034 | 98047 | CCTTAAAATTTGGA | 2-10-2 MOE | 1420 |
| 389977 | 98035 | 98046 | CTTAAAATTTGG | 1-10-1 MOE | 1421 |
| 389776 | 98035 | 98046 | CTTAAAATTTGG | 1-9-2 MOE | 1421 |
| 336207 | 102230 | 102243 | TCTACTGTTTTTGT | 3-8-3 MOE | 1422 |
| 336208 | 102236 | 102249 | GGCTCCTCTACTGT | 3-8-3 MOE | 1423 |
| 335330 | 102251 | 102265 | AGCCTCTGGATTTGA | 1-10-4 MOE | 1424 |
| 335331 | 102252 | 102266 | TAGCCTCTGGATTTG | 1-10-4 MOE | 1426 |
| 336209 | 102252 | 102265 | AGCCTCTGGATTTG | 3-8-3 MOE | 1425 |
| 335377 | 102252 | 102266 | TAGCCTCTGGATTTG | 1-10-4 Methyleneoxy BNA Phosphodiester in 3' wing | 1426 |
| 335376 | 102252 | 102266 | TAGCCTCTGGATTTG | 1-10-4 Methyleneoxy BNA | 1426 |
| 390577 | 102253 | 102266 | TAGCCTCTGGATTT | 1-10-3 MOE Unmodified cytosines | 1427 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| | | | | T's in wings are 2-thiothymines | |
| 335332 | 102253 | 102267 | CTAGCCTCTGGATTT | 1-10-4 MOE | 1429 |
| 386770 | 102253 | 102266 | TAGCCTCTGGATTT | 1-11-2 MOE | 1427 |
| 375560 | 102253 | 102267 | CTAGCCTCTGGATTT | 2-10-3 MOE | 1429 |
| 391449 | 102253 | 102267 | CTAGCCTCTGGATTT | 2-10-3 MOE Unmodified cytosines | 1429 |
| 392055 | 102253 | 102267 | CTAGCCTCTGGATTT | 2-10-3 MOE Unmodified cytosines in gap | 1429 |
| 362977 | 102253 | 102268 | GCTAGCCTCTGGATTT | 2-12-2 MOE | 1428 |
| 371975 | 102253 | 102267 | CTAGCCTCTGGATTT | 3-10-2 MOE | 1429 |
| 386556 | 102253 | 102268 | GCTAGCCTCTGGATTT | 3-10-3 MOE | 1428 |
| 335341 | 102253 | 102268 | GCTAGCCTCTGGATTT | 3-10-3 MOE | 1428 |
| 335350 | 102253 | 102268 | GCTAGCCTCTGGATTT | 3-10-3 MOE | 1428 |
| 383739 | 102253 | 102268 | GCTAGCCTCTGGATTT | 3-10-3 MOE 5-methylcytosine in gap | 1428 |
| 390576 | 102253 | 102268 | GCTAGCCTCTGGATTT | 3-10-3 MOE 5-methylcytosine in gap T's in wings are 2-thiothymines | 1428 |
| 390580 | 102253 | 102268 | GCTAGCCTCTGGATTT | 3-10-3 MOE Pyrimidines in wings are 5-thiazole Unmodified cytosines in gap | 1428 |
| 390581 | 102253 | 102268 | GCTAGCCTCTGGATTT | 3-10-3 MOE Unmodified cytosines in gap | 1428 |
| 391096 | 102253 | 102268 | GCTAGCCTCTGGATTT | 3-10-3 MOE | 1428 |
| 391098 | 102253 | 102268 | GCTAGCCTCTGGATTT | 3-10-3 MOE | 1428 |
| 391863 | 102253 | 102268 | GCTAGCCTCTGGATTT | 3-10-3 MOE Unmodified cytosines | 1428 |
| 384071 | 102253 | 102268 | GCTAGCCTCTGGATTT | 3-10-3 OMe 5-methylcytosine in gap | 1428 |
| 385036 | 102253 | 102268 | GCTAGCCTCTGGATTT | 1-2-10-3 OMe/2'-O-methyl-4'-thio/2'-O-methyl-4'-thio Unmodified cytosines in wing | 1428 |
| 335368 | 102253 | 102268 | GCTAGCCTCTGGATTT | 3-10-3 Methyleneoxy BNA Phosphodiester linkages in wings | 1428 |
| 391864 | 102253 | 102268 | GCTAGCCTCTGGATTT | 3-10-3 Methyleneoxy BNA Unmodified cytosines in gap | 1428 |
| 392054 | 102253 | 102267 | CTAGCCTCTGGATTT | 2-10-3 Methyleneoxy BNA Unmodified cytosines in gap | 1429 |
| 391172 | 102253 | 102267 | CTAGCCTCTGGATTT | 2-10-3 Methyleneoxy BNA Unmodified cytosines | 1429 |
| 391865 | 102253 | 102268 | GCTAGCCTCTGGATTT | 3-10-3 Methyleneoxy BNA Unmodified cytosines | 1428 |
| 391868 | 102253 | 102268 | GCTAGCCTCTGGATTT | 1-2-10-3 (5'R)-5'-methyl-Methyleneoxy BNA/ | 1428 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| | | | | Methyleneoxy BNA/(5'R)-5'-methyl-Methyleneoxy BNA<br>Unmodified cytosines | |
| 391869 | 102253 | 102268 | GCTAGCCTCTGGATTT | 1-2-10-3 Methyleneoxy BNA/(5'S)-5'-methyl-Methyleneoxy BNA/(5'S)-5'-methyl-Methyleneoxy BNA<br>Unmodified cytosines | 1428 |
| 384073 | 102253 | 102268 | GCTAGCCTCTGGATTT | 3-10-3 Methyleneoxy BNA<br>5-methylcytosine in gap | 1428 |
| 335379 | 102253 | 102268 | GCTAGCCTCTGGATTT | 3-10-3 Methyleneoxy BNA | 1428 |
| 390579 | 102253 | 102268 | GCTAGCCTCTGGATTT | 1-1-1-10-3 MOE/4'thio/2'-O-[(2-methoxy)ethyl]-4'-thio/2'-O-[(2-methoxy)ethyl]-4'-thio<br>Unmodified cytosines in wings<br>Phosphorodiester linkage in wings | 1428 |
| 390582 | 102253 | 102268 | GCTAGCCTCTGGATTT | 1-2-10-3 MOE/4'thio/2'-O-[(2-methoxy)ethyl]-4'-thio<br>Unmodified cytosines in wings<br>Phosphorodiester linkage in wings | 1428 |
| 390606 | 102253 | 102268 | GCTAGCCTCTGGATTT | 1-2-10-3 MOE/pentaF/pentaF<br>Unmodified cytosines in wings<br>Phosphodiester linkage in wings | 1428 |
| 384072 | 102253 | 102268 | GCTAGCCTCTGGATTT | 1-2-10-3 MOE/pentaF/pentaF<br>Unmodified cytosines in wings | 1428 |
| 385871 | 102253 | 102268 | GCTAGCCTCTGGATTT | 1-2-10-3 OMe/2'-O-[(2-methoxy)ethyl]-4'-thio/2'-O-[(2-methoxy)ethyl]-4'-thio<br>Unmodified cytosines in wing | 1428 |
| 390607 | 102253 | 102268 | GCTAGCCTCTGGATTT | 3-10-3 MOE/pentaF<br>Unmodified cytosines in wing | 1428 |
| 390608 | 102253 | 102268 | GCTAGCCTCTGGATTT | 1-2-10-3 MOE/pentaF/pentaF<br>Unmodified cytosines in wing | 1428 |
| 390609 | 102253 | 102268 | GCTAGCCTCTGGATTT | 3-10-2-1 MOE/MOE/pentaF<br>Unmodified cytosines in wing | 1428 |
| 386682 | 102253 | 102268 | GCTAGCCTCTGGATTT | 1-2-10-3 2'-(butylacetamido)-palmitamide/MOE/MOE | 1428 |
| 391173 | 102253 | 102267 | CTAGCCTCTGGATTT | 2-10-3 (5'R)-5'-methyl-Methyleneoxy BNA<br>Unmodified cytosines | 1429 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 391174 | 102253 | 102267 | CTAGCCTCTGGATTT | 2-10-3 (5'S)-5'-methyl-Methyleneoxy BNA Unmodified cytosines | 1429 |
| 386970 | 102254 | 102266 | TAGCCTCTGGATT | 1-10-2 MOE | 1432 |
| 390578 | 102254 | 102266 | TAGCCTCTGGATT | 1-10-2 MOE Unmodified cytosines Ts in wings are 2-thiothymines | 1432 |
| 335333 | 102254 | 102268 | GCTAGCCTCTGGATT | 1-10-4 MOE | 1430 |
| 331429 | 102254 | 102267 | CTAGCCTCTGGATT | 2-10-2 MOE | 1431 |
| 335349 | 102254 | 102267 | CTAGCCTCTGGATT | 2-10-2 MOE | 1431 |
| 335367 | 102254 | 102267 | CTAGCCTCTGGATT | 2-10-2 Methyleneoxy BNA Phosphodiester linkages in wings | 1431 |
| 392061 | 102254 | 102267 | CTAGCCTCTGGATT | 2-10-2 Methyleneoxy BNA Unmodified cytosines in gap | 1431 |
| 335378 | 102254 | 102267 | CTAGCCTCTGGATT | 2-10-2 Methyleneoxy BNA | 1431 |
| 383991 | 102254 | 102266 | TAGCCTCTGGATT | 1-10-2 2'-(acetylamino-butyl-acetamido)-cholesterol/MOE | 1432 |
| 383992 | 102254 | 102266 | TAGCCTCTGGATT | 1-10-2 2'-(acetylamino-butyl-acetamido)-cholic acid/MOE | 1432 |
| 386683 | 102254 | 102266 | TAGCCTCTGGATT | 1-10-2 5' terminal 2'-(butylacetamido)-palmitamide/MOE | 1432 |
| 390614 | 102254 | 102266 | TAGCCTCTGGATT | 1-10-2 PentaF | 1432 |
| 389954 | 102255 | 102266 | TAGCCTCTGGAT | 1-10-1 MOE | 1434 |
| 335334 | 102255 | 102269 | TGCTAGCCTCTGGAT | 1-10-4 MOE | 1433 |
| 389777 | 102255 | 102266 | TAGCCTCTGGAT | 1-9-2 MOE | 1434 |
| 390430 | 102256 | 102268 | GCTAGCCTCTGGA | 1-10-2 MOE Unmodified cytosines | 1163 |
| 390431 | 102256 | 102268 | GCTAGCCTCTGGA | 1-10-2 MOE Unmodified cytosines C in wing 9-(aminoethoxy)phenoxazine | 1163 |
| 390432 | 102256 | 102268 | GCTAGCCTCTGGA | 1-10-2 MOE | 1163 |
| 390433 | 102256 | 102268 | GCTAGCCTCTGGA | 1-10-2 MOE Unmodified cytosines Nt 6 is 9-(aminoethoxy)phenoxazine | 1163 |
| 390434 | 102256 | 102268 | GCTAGCCTCTGGA | 1-10-2 MOE Unmodified cytosines Nt 7 is 9-(aminoethoxy)phenoxazine | 1163 |
| 390435 | 102256 | 102268 | GCTAGCCTCTGGA | 1-10-2 MOE Unmodified cytosines Nt 9 is 9-(aminoethoxy)phenoxazine | 1163 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 335335 | 102256 | 102270 | CTGCTAGCCTCTGGA | 1-10-4 MOE | 1435 |
| 335336 | 102257 | 102271 | ACTGCTAGCCTCTGG | 1-10-4 MOE | 1436 |
| 335337 | 102258 | 102272 | AACTGCTAGCCTCTG | 1-10-4 MOE | 1437 |
| 335338 | 102259 | 102273 | GAACTGCTAGCCTCT | 1-10-4 MOE | 1438 |
| 335339 | 102260 | 102274 | TGAACTGCTAGCCTC | 1-10-4 MOE | 1439 |
| 335340 | 102261 | 102275 | TTGAACTGCTAGCCT | 1-10-4 MOE | 1440 |
| 336210 | 102261 | 102274 | TGAACTGCTAGCCT | 3-8-3 MOE | 1441 |
| 397991 | 102264 | 102277 | AGTTGAACTGCTAG | 2-10-2 MOE | 1442 |
| 398059 | 102265 | 102276 | GTTGAACTGCTA | 1-10-1 MOE | 1443 |
| 390017 | 102268 | 102279 | GAAGTTGAACTG | 1-10-1 MOE | 1444 |
| 336211 | 102269 | 102282 | ACAGAAGTTGAACT | 3-8-3 MOE | 1445 |
| 397992 | 102293 | 102306 | TCATTGTCACTAAC | 2-10-2 MOE | 1446 |
| 336212 | 102293 | 102306 | TCATTGTCACTAAC | 3-8-3 MOE | 1446 |
| 398060 | 102294 | 102305 | CATTGTCACTAA | 1-10-1 MOE | 1447 |
| 389978 | 102301 | 102312 | TCAGGTTCATTG | 1-10-1 MOE | 1448 |
| 389778 | 102301 | 102312 | TCAGGTTCATTG | 1-9-2 MOE | 1448 |
| 336213 | 102303 | 102316 | ATGATCAGGTTCAT | 3-8-3 MOE | 1449 |
| 397993 | 102307 | 102320 | TATAATGATCAGGT | 2-10-2 MOE | 1450 |
| 398061 | 102308 | 102319 | ATAATGATCAGG | 1-10-1 MOE | 1451 |
| 336214 | 102314 | 102327 | GAATATCTATAATG | 3-8-3 MOE | 1139 |
| 390019 | 102320 | 102331 | GTCAGAATATCT | 1-10-1 MOE | 1173 |
| 397994 | 102322 | 102335 | TGGTGTCAGAATAT | 2-10-2 MOE | 1452 |
| 398062 | 102323 | 102334 | GGTGTCAGAATA | 1-10-1 MOE | 1255 |
| 336215 | 102326 | 102339 | TCAGTGGTGTCAGA | 3-8-3 MOE | 1453 |
| 336216 | 102339 | 102352 | CTCTGGATCAGAGT | 3-8-3 MOE | 1454 |
| 390020 | 102340 | 102351 | TCTGGATCAGAG | 1-10-1 MOE | 1149 |
| 336217 | 102349 | 102362 | AAGGTTCATTCTCT | 3-8-3 MOE | 1455 |
| 397995 | 102357 | 102370 | TTCATCAAAAGGTT | 2-10-2 MOE | 1456 |
| 389979 | 102358 | 102369 | TCATCAAAAGGT | 1-10-1 MOE | 1176 |
| 389779 | 102358 | 102369 | TCATCAAAAGGT | 1-9-2 MOE | 1176 |
| 336218 | 102358 | 102371 | CTTCATCAAAAGGT | 3-8-3 MOE | 1457 |
| 390021 | 102360 | 102371 | CTTCATCAAAAG | 1-10-1 MOE | 1458 |
| 336219 | 102366 | 102379 | ATGCTGATCTTCAT | 3-8-3 MOE | 1459 |
| 336220 | 102381 | 102394 | TTTTGTAATTTGTG | 3-8-3 MOE | 1460 |
| 336221 | 102387 | 102400 | TCAGACTTTTGTAA | 3-8-3 MOE | 1461 |
| 390022 | 102443 | 102454 | CAGTTTATTCAA | 1-10-1 MOE | 1142 |
| 397996 | 102477 | 102490 | TGTCCTATTGCCAT | 2-10-2 MOE | 1462 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 398063 | 102478 | 102489 | GTCCTATTGCCA | 1-10-1 MOE | 1205 |
| 397997 | 102487 | 102500 | TCTGACACAATGTC | 2-10-2 MOE | 1463 |
| 398064 | 102488 | 102499 | CTGACACAATGT | 1-10-1 MOE | 1464 |
| 397998 | 102505 | 102518 | TGTTCCTATAACTG | 2-10-2 MOE | 1465 |
| 398065 | 102506 | 102517 | GTTCCTATAACT | 1-10-1 MOE | 1466 |
| 397999 | 102528 | 102541 | AAGATTGGTCAGGA | 2-10-2 MOE | 1467 |
| 398066 | 102529 | 102540 | AGATTGGTCAGG | 1-10-1 MOE | 1468 |
| 398000 | 102561 | 102574 | GTGTCAAAACCCTG | 2-10-2 MOE | 1469 |
| 398067 | 102562 | 102573 | TGTCAAAACCCT | 1-10-1 MOE | 1210 |
| 390025 | 102563 | 102574 | GTGTCAAAACCC | 1-10-1 MOE | 1211 |
| 390026 | 102595 | 102606 | AGCTACACAACC | 1-10-1 MOE | 1470 |
| 398001 | 102596 | 102609 | CACAGCTACACAAC | 2-10-2 MOE | 1471 |
| 398068 | 102597 | 102608 | ACAGCTACACAA | 1-10-1 MOE | 1472 |
| 398002 | 102607 | 102620 | TATATACATGACAC | 2-10-2 MOE | 1473 |
| 398069 | 102608 | 102619 | ATATACATGACA | 1-10-1 MOE | 1474 |
| 390027 | 102612 | 102623 | AGGTATATACAT | 1-10-1 MOE | 1206 |
| 398003 | 102637 | 102650 | AATTTTAAATGTCC | 2-10-2 MOE | 1475 |
| 398070 | 102638 | 102649 | ATTTTAAATGTC | 1-10-1 MOE | 1476 |
| 390028 | 102648 | 102659 | TCCTAATTGAAT | 1-10-1 MOE | 1477 |
| 390029 | 102667 | 102678 | AAAGTGCCATCT | 1-10-1 MOE | 1478 |
| 398004 | 102689 | 102702 | TTTATAAAACTGGA | 2-10-2 MOE | 1479 |
| 398071 | 102690 | 102701 | TTATAAAACTGG | 1-10-1 MOE | 1480 |
| 390030 | 102691 | 102702 | TTTATAAAACTG | 1-10-1 MOE | 1074 |
| 398005 | 102827 | 102840 | TGCAAACTTATCTG | 2-10-2 MOE | 1481 |
| 398072 | 102828 | 102839 | GCAAACTTATCT | 1-10-1 MOE | 1482 |
| 390033 | 102836 | 102847 | AGCCAACTGCAA | 1-10-1 MOE | 1483 |
| 398006 | 102837 | 102850 | CTTAGCCAACTGCA | 2-10-2 MOE | 1484 |
| 398073 | 102838 | 102849 | TTAGCCAACTGC | 1-10-1 MOE | 1485 |
| 398007 | 103069 | 103082 | AGCACCAATATGCT | 2-10-2 MOE | 1247 |
| 398074 | 103070 | 103081 | GCACCAATATGC | 1-10-1 MOE | 1248 |
| 398008 | 103267 | 103280 | TAAATCATTGTCAA | 2-10-2 MOE | 1486 |
| 398075 | 103268 | 103279 | AAATCATTGTCA | 1-10-1 MOE | 1233 |
| 398009 | 103327 | 103340 | GCACTGGCCTTGAT | 2-10-2 MOE | 1487 |
| 398076 | 103328 | 103339 | CACTGGCCTTGA | 1-10-1 MOE | 1488 |
| 390041 | 103332 | 103343 | TTAGCACTGGCC | 1-10-1 MOE | 1489 |
| 390047 | 103585 | 103596 | TGTGTAAGGTCA | 1-10-1 MOE | 1490 |
| 390049 | 103636 | 103647 | GTTAATGACATT | 1-10-1 MOE | 1491 |

TABLE 22-continued

Short Antisense Compounds targeted to SEQ ID NO: 15

| ISIS No. | 5' Target Site | 3' Target Site | Sequence (5'-3') | Gapmer Motif | SEQ ID NO |
|---|---|---|---|---|---|
| 390050 | 103660 | 103671 | GTATTCAAGTAA | 1-10-1 MOE | 1140 |
| 390052 | 103780 | 103791 | GACAATTTCTAC | 1-10-1 MOE | 1492 |
| 390054 | 103862 | 103873 | AACACTGCACAT | 1-10-1 MOE | 1493 |

Salts, Prodrugs and Bioequivalents

The antisense compounds provided herein comprise any pharmaceutically acceptable salts, esters, or salts of such esters, or any other functional chemical equivalent which, upon administration to an animal including a human, is capable of providing (directly or indirectly) the biologically active metabolite or residue thereof. Accordingly, for example, the disclosure is also drawn to prodrugs and pharmaceutically acceptable salts of the antisense compounds, pharmaceutically acceptable salts of such prodrugs, and other bioequivalents.

The term "prodrug" indicates a therapeutic agent that is prepared in an inactive or less active form that is converted to an active form (i.e., drug) within the body or cells thereof by the action of endogenous enzymes, chemicals, and/or conditions. In particular, prodrug versions of the oligonucleotides are prepared as SATE ((S-acetyl-2-thioethyl) phosphate) derivatives according to the methods disclosed in WO 93/24510 or WO 94/26764. Prodrugs can also include antisense compounds wherein one or both ends comprise nucleobases that are cleaved (e.g., by incorporating phosphodiester backbone linkages at the ends) to produce the active compound. In certain embodiments, one or more non-drug moieties is cleaved from a prodrug to yield the active form. In certain such embodiments, such non-drug moieties is not a nucleotide or oligonucleotide.

The term "pharmaceutically acceptable salts" refers to physiologically and pharmaceutically acceptable salts of the compounds described herein: i.e., salts that retain the desired biological activity of the parent compound and do not impart undesired toxicological effects thereto. Sodium salts of antisense oligonucleotides are useful and are well accepted for therapeutic administration to humans.

In certain embodiments, salts, including, but not limited to sodium salts, of double stranded nucleic acids (including but not limited to dsRNA compounds) are also provided.

G. CERTAIN PHARMACEUTICAL COMPOSITIONS

In certain embodiments, pharmaceutical compositions of the present invention comprise one or more short antisense compound and one or more excipients. In certain such embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, a pharmaceutical composition of the present invention is prepared using known techniques, including, but not limited to mixing, dissolving, granulating, dragee-making, levigating, emulsifying, encapsulating, entrapping or tabletting processes.

In certain embodiments, a pharmaceutical composition of the present invention is a liquid (e.g., a suspension, elixir and/or solution). In certain of such embodiments, a liquid pharmaceutical composition is prepared using ingredients known in the art, including, but not limited to, water, glycols, oils, alcohols, flavoring agents, preservatives, and coloring agents.

In certain embodiments, a pharmaceutical composition of the present invention is a solid (e.g., a powder, tablet, and/or capsule). In certain of such embodiments, a solid pharmaceutical composition comprising one or more oligonucleotides is prepared using ingredients known in the art, including, but not limited to, starches, sugars, diluents, granulating agents, lubricants, binders, and disintegrating agents.

In certain embodiments, a pharmaceutical composition of the present invention is formulated as a depot preparation. Certain such depot preparations are typically longer acting than non-depot preparations. In certain embodiments, such preparations are administered by implantation (for example subcutaneously or intramuscularly) or by intramuscular injection. In certain embodiments, depot preparations are prepared using suitable polymeric or hydrophobic materials (for example an emulsion in an acceptable oil) or ion exchange resins, or as sparingly soluble derivatives, for example, as a sparingly soluble salt.

In certain embodiments, a pharmaceutical composition of the present invention comprises a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, a pharmaceutical composition of the present invention comprises one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, a pharmaceutical composition of the present invention comprises a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™, and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, a pharmaceutical composition of the present invention comprises a sustained-release system. A non-limiting example of such a sustained-release system is a semi-permeable matrix of solid hydrophobic polymers. In certain embodiments, sustained-release systems may, depending on their chemical nature, release pharmaceutical agents over a period of hours, days, weeks or months.

In certain embodiments, a pharmaceutical composition of the present invention is prepared for oral administration. In certain of such embodiments, a pharmaceutical composition is formulated by combining one or more oligonucleotides with one or more pharmaceutically acceptable carriers. Certain of such carriers enable pharmaceutical compositions to be formulated as tablets, pills, dragees, capsules, liquids, gels, syrups, slurries, suspensions and the like, for oral ingestion by a subject. In certain embodiments, pharmaceutical compositions for oral use are obtained by mixing oligonucleotide and one or more solid excipient. Suitable excipients include, but are not limited to, fillers, such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carboxymethylcellulose, and/or polyvinylpyrrolidone (PVP). In certain embodiments, such a mixture is optionally ground and auxiliaries are optionally added. In certain embodiments, pharmaceutical compositions are formed to obtain tablets or dragee cores. In certain embodiments, disintegrating agents (e.g., cross-linked polyvinyl pyrrolidone, agar, or alginic acid or a salt thereof, such as sodium alginate) are added.

In certain embodiments, dragee cores are provided with coatings. In certain such embodiments, concentrated sugar solutions may be used, which may optionally comprise gum arabic, talc, polyvinyl pyrrolidone, carbopol gel, polyethylene glycol, and/or titanium dioxide, lacquer solutions, and suitable organic solvents or solvent mixtures. Dyestuffs or pigments may be added to tablets or dragee coatings.

In certain embodiments, pharmaceutical compositions for oral administration are push-fit capsules made of gelatin. Certain of such push-fit capsules comprise one or more pharmaceutical agents of the present invention in admixture with one or more filler such as lactose, binders such as starches, and/or lubricants such as talc or magnesium stearate and, optionally, stabilizers. In certain embodiments, pharmaceutical compositions for oral administration are soft, sealed capsules made of gelatin and a plasticizer, such as glycerol or sorbitol. In certain soft capsules, one or more pharmaceutical agents of the present invention are be dissolved or suspended in suitable liquids, such as fatty oils, liquid paraffin, or liquid polyethylene glycols. In addition, stabilizers may be added.

In certain embodiments, pharmaceutical compositions are prepared for buccal administration. Certain of such pharmaceutical compositions are tablets or lozenges formulated in conventional manner.

In certain embodiments, a pharmaceutical composition is prepared for administration by injection (e.g., intravenous, subcutaneous, intramuscular, etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may comprise formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes. Aqueous injection suspensions may comprise substances that increase the viscosity of the suspension, such as sodium carboxymethyl cellulose, sorbitol, or dextran. Optionally, such suspensions may also comprise suitable stabilizers or agents that increase the solubility of the pharmaceutical agents to allow for the preparation of highly concentrated solutions.

In certain embodiments, a pharmaceutical composition is prepared for transmucosal administration. In certain of such embodiments penetrants appropriate to the barrier to be permeated are used in the formulation. Such penetrants are generally known in the art.

In certain embodiments, a pharmaceutical composition is prepared for administration by inhalation. Certain of such pharmaceutical compositions for inhalation are prepared in the form of an aerosol spray in a pressurized pack or a nebulizer. Certain of such pharmaceutical compositions comprise a propellant, e.g., dichlorodifluoromethane, trichlorofluoromethane, dichlorotetrafluoroethane, carbon dioxide or other suitable gas. In certain embodiments using a pressurized aerosol, the dosage unit may be determined with a valve that delivers a metered amount. In certain embodiments, capsules and cartridges for use in an inhaler or insufflator may be formulated. Certain of such formulations comprise a powder mixture of a pharmaceutical agent of the invention and a suitable powder base such as lactose or starch.

In certain embodiments, a pharmaceutical composition is prepared for rectal administration, such as a suppositories or retention enema. Certain of such pharmaceutical compositions comprise known ingredients, such as cocoa butter and/or other glycerides.

In certain embodiments, a pharmaceutical composition is prepared for topical administration. Certain of such pharmaceutical compositions comprise bland moisturizing bases, such as ointments or creams. Exemplary suitable ointment bases include, but are not limited to, petrolatum, petrolatum plus volatile silicones, lanolin and water in oil emulsions such as Eucerin™, available from Beiersdorf (Cincinnati, Ohio). Exemplary suitable cream bases include, but are not limited to, Nivea™ Cream, available from Beiersdorf (Cincinnati, Ohio), cold cream (USP), Purpose Cream™, available from Johnson & Johnson (New Brunswick, N.J.), hydrophilic ointment (USP) and Lubriderm™, available from Pfizer (Morris Plains, N.J.).

In certain embodiments, a pharmaceutical composition of the present invention comprises an oligonucleotide in a therapeutically effective amount. In certain embodiments, the therapeutically effective amount is sufficient to prevent, alleviate or ameliorate symptoms of a disease or to prolong the survival of the subject being treated. Determination of a therapeutically effective amount is well within the capability of those skilled in the art.

In certain embodiments, one or more short antisense compound of the present invention is formulated as a prodrug. In certain embodiments, upon in vivo administration, a prodrug is chemically converted to the biologically, pharmaceutically or therapeutically more active form of the short antisense compound. In certain embodiments, prodrugs are useful because they are easier to administer than the corresponding active form. For example, in certain instances, a prodrug may be more bioavailable (e.g., through oral administration) than is the corresponding active form. In certain instances, a prodrug may have improved solubility compared to the corresponding active form. In certain embodiments, prodrugs are less water soluble than the corresponding active form. In certain instances, such prodrugs possess superior transmittal across cell membranes, where water solubility is detrimental to mobility. In certain embodiments, a prodrug is an ester. In certain such embodiments, the ester is metabolically hydrolyzed to carboxylic acid upon administration. In certain instances the carboxylic acid containing compound is the corresponding active form. In certain embodiments, a prodrug comprises a short peptide (polyaminoacid) bound to an acid group. In certain of such embodiments, the peptide is cleaved upon administration to form the corresponding active form.

In certain embodiments, a prodrug is produced by modifying a pharmaceutically active compound such that the active compound will be regenerated upon in vivo administration. The prodrug can be designed to alter the metabolic stability or the transport characteristics of a drug, to mask side effects or toxicity, to improve the flavor of a drug or to alter other characteristics or properties of a drug. By virtue of knowledge of pharmacodynamic processes and drug metabolism in vivo, those of skill in this art, once a pharmaceutically active compound is known, can design prodrugs of the compound (see, e.g., Nogrady (1985) Medicinal Chemistry A Biochemical Approach, Oxford University Press, New York, pages 388-392).

In certain embodiments, a pharmaceutical composition comprising one or more pharmaceutical agents of the present invention is useful for treating a conditions or disorders in a mammalian, and particularly in a human, subject. Suitable administration routes include, but are not limited to, oral, rectal, transmucosal, intestinal, enteral, topical, suppository, through inhalation, intrathecal, intraventricular, intraperitoneal, intranasal, intraocular and parenteral (e.g., intravenous, intramuscular, intramedullary, and subcutaneous). In certain embodiments, pharmaceutical intrathecals are administered to achieve local rather than systemic exposures. For example, pharmaceutical compositions may be injected directly in the area of desired effect (e.g., in the renal or cardiac area).

In certain embodiments, short antisense compounds, compared to their parent oligonucleotides, make them particularly suited to oral administration. In certain embodiments, short antisense compounds are better suited for oral administration than their parent oligonucleotides because they have increased potency compared to those parent oligonucleotides. In certain embodiments, short antisense compounds are better suited for oral administration than their parent oligonucleotides because they have better stability, availability or solubility properties compared to those parent oligonucleotides.

In a further aspect, a pharmaceutical agent is sterile lyophilized oligonucleotide that is reconstituted with a suitable diluent, e.g., sterile water for injection. The reconstituted product is administered as a subcutaneous injection or as an intravenous infusion after dilution into saline. The lyophilized drug product consists of the oligonucleotide which has been prepared in water for injection, adjusted to pH 7.0-9.0 with acid or base during preparation, and then lyophilized. The lyophilized oligonucleotide may be 25-800 mg of the oligonucleotide. It is understood that this encompasses 25, 50, 75, 100, 125, 150, 175, 200, 225, 250, 275, 300, 325, 350, 375, 425, 450, 475, 500, 525, 550, 575, 600, 625, 650, 675, 700, 725, 750, 775, and 800 mg of lyophilized oligonucleotide. The lyophilized drug product may be packaged in a 2 mL Type I, clear glass vial (ammonium sulfate-treated), stoppered with a bromobutyl rubber closure and sealed with an aluminum FLIP-OFF® overseal.

The compositions of the present invention may additionally comprise other adjunct components conventionally found in pharmaceutical compositions, at their art-established usage levels. Thus, for example, the compositions may comprise additional, compatible, pharmaceutically-active materials such as, for example, antipruritics, astringents, local anesthetics or anti-inflammatory agents, or may comprise additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the oligonucleotide(s) of the formulation.

The antisense compounds provided herein may also be admixed, encapsulated, conjugated or otherwise associated with other molecules, molecule structures or mixtures of compounds.

Also described herein are pharmaceutical compositions and formulations which include the antisense compounds provided herein. The pharmaceutical compositions may be administered in a number of ways depending upon whether local or systemic treatment is desired and upon the area to be treated. In a preferred embodiment, administration is topical to the surface of the respiratory tract, particularly pulmonary, e.g., by nebulization, inhalation, or insufflation of powders or aerosols, by mouth and/or nose.

The pharmaceutical formulations described herein, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers, finely divided solid carriers, or both, and then, if necessary, shaping the product (e.g., into a specific particle size for delivery). In a preferred embodiment, the pharmaceutical formulations are prepared for pulmonary administration in an appropriate solvent, e.g., water or normal saline, possibly in a sterile formulation, with carriers or other agents to allow for the formation of droplets of the desired diameter for delivery using inhalers, nasal delivery devices, nebulizers, and other devices for pulmonary delivery. Alternatively, the pharmaceutical formulations may be formulated as dry powders for use in dry powder inhalers.

A "pharmaceutical carrier" or "excipient" can be a pharmaceutically acceptable solvent, suspending agent or any other pharmacologically inert vehicle for delivering one or more nucleic acids to an individual and are known in the art. The excipient may be liquid or solid and is selected, with the planned manner of administration in mind, so as to provide

H. CERTAIN THERAPEUTIC USES

In certain embodiments, antisense compounds are used to modulate the expression of a target gene in an animal, such as a human. In certain embodiments, such compounds can be used to treat metabolic disorders or modulate one or more disease indications. For example, the methods comprise the step of administering to said animal in need of therapy for a disease or condition associated with a target gene an effective amount of an antisense compound that modulates expression of the target gene. Antisense compounds provided herein which effectively modulate expression of a target RNA or protein products of expression are considered active antisense compounds. Active antisense compounds also include compounds which effectively modulate one or more of a number of disease indications, including metabolic and cardiovascular disease indications, examples of which are described below.

Modulation of expression of a target gene can be measured in a bodily fluid, which may or may not contain cells; tissue; or organ of the animal. Methods of obtaining samples for analysis, such as body fluids (e.g., sputum, serum, urine), tissues (e.g., biopsy), or organs, and methods of preparation of the samples to allow for analysis are well known to those skilled in the art. Methods for analysis of RNA and protein levels are discussed above and are well known to those skilled in the art. The effects of treatment can be assessed by measuring biomarkers, or disease indications, associated with the target gene expression in the aforementioned fluids, tissues or organs, collected from an animal contacted with one or more compounds described herein, by routine clinical methods known in the art. These biomarkers include but are not limited to: liver transaminases, bilirubin, albumin, blood urea nitrogen, creatine and other markers of kidney and liver function; interleukins, tumor necrosis factors, intracellular adhesion molecules, C-reactive protein, chemokines, cytokines, and other markers of inflammation.

The antisense compounds provided herein can be utilized in pharmaceutical compositions by adding an effective amount of a compound to a suitable pharmaceutically acceptable diluent or carrier. Acceptable carriers and diluents are well known to those skilled in the art. Selection of a diluent or carrier is based on a number of factors, including, but not limited to, the solubility of the compound and the route of administration. Such considerations are well understood by those skilled in the art. In one aspect, the antisense compounds described herein inhibit expression of a target gene. The compounds can also be used in the manufacture of a medicament for the treatment of diseases and disorders related to a target gene.

Methods whereby bodily fluids, organs or tissues are contacted with an effective amount of one or more of the antisense compounds or compositions provided herein are also contemplated. Bodily fluids, organs or tissues can be contacted with one or more of the compounds resulting in modulation of target gene expression in the cells of bodily fluids, organs or tissues. An effective amount can be determined by monitoring the modulatory effect of the antisense compound or compounds or compositions on target nucleic acids or their products by methods routine to the skilled artisan.

Co-Administration

In certain embodiments, two or more antisense compounds are co-administered. In certain embodiments, pharmaceutical compositions include one or more antisense compounds, particularly oligonucleotides, targeted to a first nucleic acid and one or more antisense compounds targeted to a second nucleic acid target. One or more of those antisense compounds may be a short antisense compound. In certain embodiments, pharmaceutical compositions include two or more antisense compounds targeted to different regions of the same nucleic acid target. One or more of such antisense compounds may be a short antisense compound. Two or more combined compounds may be used together or sequentially.

In certain embodiments, one or more pharmaceutical compositions are co-administered with one or more other pharmaceutical agents. In certain embodiments, such one or more other pharmaceutical agents are designed to treat the same disease or condition as the one or more pharmaceutical compositions of the present invention. In certain embodiments, such one or more other pharmaceutical agents are designed to treat a different disease or condition as the one or more pharmaceutical compositions of the present invention. In certain embodiments, such one or more other pharmaceutical agents are designed to treat an undesired effect of one or more pharmaceutical compositions of the present invention. In certain embodiments, one or more pharmaceutical compositions of the present invention are co-administered with another pharmaceutical agent to treat an undesired effect of that other pharmaceutical agent. In certain embodiments, one or more pharmaceutical compositions of the present invention and one or more other pharmaceutical agents are administered at the same time. In certain embodiments, one or more pharmaceutical compositions of the present invention and one or more other pharmaceutical agents are administered at different times. In certain embodiments, one or more pharmaceutical compositions of the present invention and one or more other pharmaceutical agents are prepared together in a single formulation. In certain embodiments, one or more pharmaceutical compositions of the present invention and one or more other pharmaceutical agents are prepared separately.

In certain embodiments, pharmaceutical agents that may be co-administered with a pharmaceutical composition of the present invention include lipid-lowering agents. In certain such embodiments, pharmaceutical agents that may be co-administered with a pharmaceutical composition of the present invention include, but are not limited to atorvastatin, simvastatin, rosuvastatin, and ezetimibe. In certain such embodiments, the lipid-lowering agent is administered prior to administration of a pharmaceutical composition of the present invention. In certain such embodiments, the lipid-lowering agent is administered following administration of a pharmaceutical composition of the present invention. In certain such embodiments the lipid-lowering agent is administered at the same time as a pharmaceutical composition of the present invention. In certain such embodiments the dose of a co-administered lipid-lowering agent is the same as the dose that would be administered if the lipid-lowering agent was administered alone. In certain such embodiments the dose of a co-administered lipid-lowering agent is lower than the dose that would be administered if the lipid-lowering agent was administered alone. In certain such embodiments the dose of a co-administered lipid-lowering agent is greater than the dose that would be administered if the lipid-lowering agent was administered alone.

In certain embodiments, a co-administered lipid-lowering agent is a HMG-CoA reductase inhibitor. In certain such embodiments the HMG-CoA reductase inhibitor is a statin. In certain such embodiments the statin is selected from atorvastatin, simvastatin, pravastatin, fluvastatin, and rosuvastatin.

In certain embodiments, a co-administered lipid-lowering agent is a cholesterol absorption inhibitor. In certain such embodiments, cholesterol absorption inhibitor is ezetimibe. In certain embodiments, a co-administered lipid-lowering agent is a co-formulated HMG-CoA reductase inhibitor and cholesterol absorption inhibitor. In certain such embodiments the co-formulated lipid-lowering agent is ezetimibe/simvastatin. In certain embodiments, a co-administered lipid-lowering agent is a microsomal triglyceride transfer protein inhibitor.

In certain embodiments, a co-administered pharmaceutical agent is a bile acid sequestrant. In certain such embodiments, the bile acid sequestrant is selected from cholestyramine, colestipol, and colesevelam.

In certain embodiments, a co-administered pharmaceutical agent is a nicotinic acid. In certain such embodiments, the nicotinic acid is selected from immediate release nicotinic acid, extended release nicotinic acid, and sustained release nicotinic acid.

In certain embodiments, a co-administered pharmaceutical agent is a fibric acid. In certain such embodiments, a fibric acid is selected from gemfibrozil, fenofibrate, clofibrate, bezafibrate, and ciprofibrate.

Further examples of pharmaceutical agents that may be co-administered with a pharmaceutical composition of the present invention include, but are not limited to, corticosteroids, including but not limited to prednisone; immunoglobulins, including, but not limited to intravenous immunoglobulin (IVIg); analgesics (e.g., acetaminophen); anti-inflammatory agents, including, but not limited to non-steroidal anti-inflammatory drugs (e.g., ibuprofen, COX-1 inhibitors, and COX-2, inhibitors); salicylates; antibiotics; antivirals; antifungal agents; antidiabetic agents (e.g., biguanides, glucosidase inhibitors, insulins, sulfonylureas, and thiazolidenediones); adrenergic modifiers; diuretics; hormones (e.g., anabolic steroids, androgen, estrogen, calcitonin, progestin, somatostan, and thyroid hormones); immunomodulators; muscle relaxants; antihistamines; osteoporosis agents (e.g., biphosphonates, calcitonin, and estrogens); prostaglandins, antineoplastic agents; psychotherapeutic agents; sedatives; poison oak or poison sumac products; antibodies; vaccines.

In certain embodiments, the pharmaceutical compositions of the present invention may be administered in conjuction with a lipid-lowering therapy. In certain such embodiments, a lipid-lowering therapy is therapeutic lifestyle change. In certain such embodiments, a lipid-lowering therapy is LDL apheresis.

I. KITS, RESEARCH REAGENTS AND DIAGNOSTICS

The antisense compounds provided herein can be utilized for diagnostics, and as research reagents and kits. Furthermore, antisense compounds, which are able to inhibit gene expression or modulate gene expression with specificity, are often used by those of ordinary skill to elucidate the function of particular genes or to distinguish between functions of various members of a biological pathway.

For use in kits and diagnostics, the antisense compounds described herein, either alone or in combination with other compounds or therapeutics, can be used as tools in differential and/or combinatorial analyses to elucidate expression patterns of a portion or the entire complement of genes expressed within cells and tissues. Methods of gene expression analysis are well known to those skilled in the art.

J. CERTAIN ADVANTAGES OF SHORT ANTISENSE COMPOUNDS

In certain embodiments, short antisense compounds have advantages when compared to their parent oligonucleotides. For example, in certain embodiments, short antisense compounds have greater affinity for a target nucleic acid than their parent oligonucleotide. In certain embodiments, short antisense compounds have greater potency in vitro than their parent oligonucleotide. In certain such embodiments, that increased in vitro potency is not entirely explained by increased affinity. In certain embodiments, such increased in vitro potency may be attributable to increased ability of short antisense compounds to penetrate cells and/or increased ability to access target nucleic acids in a cell. In certain embodiments, short antisense compounds have greater potency in vivo than their parent oligonucleotides. In certain embodiments, such greater in vivo potency is not attributable to increased in vitro potency or increased affinity. In certain embodiments, short antisense compounds have even greater in vivo potency compared to their parent oligonucleotides than would be predicted based on in vitro potencies or on affinities. In certain embodiments, such increased in vivo potency may be attributable to increased bioavailability, better penetration into the cell, better access to target nucleic acid once in the cell, or other factors.

In certain embodiments, one would expect short antisense compounds to be less specific for their target nucleic acid compared to their parent oligonucleotides. In certain such embodiments, one would expect increased side-effects, including potential for toxic effects, from short antisense compounds. In certain embodiments, such additional side-effects are not observed. In certain embodiments, non-target nucleic acids to which a particular short antisense compound may bind are not available to the short antisense compound. In such embodiments, side-effects, including toxicity, are less problematic than would be predicted.

In certain embodiments, because they are smaller, short antisense compounds are less likely to bind proteins. In certain such embodiments, such less binding of proteins results in lower toxicity, since protein binding may have undesired consequences. In certain embodiments, such less binding of proteins results in greater potency, since it leaves more antisense compound available for therapeutic effect. In certain embodiments, less binding of proteins results in decreased drug-drug interaction toxicity.

NONLIMITING DISCLOSURE AND INCORPORATION BY REFERENCE

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Example 1

Cell Culture and Treatment with Short Antisense Compounds

The effect of short antisense compounds on target nucleic acid expression can be tested in any one of a number of cultured or primary cell lines. Cells lines can be obtained from publicly available sources, such as the American Type Culture Collection (Manassas, Va.). Cells are cultured according to methods well known to those of ordinary skill in the art.

When cells reached appropriate confluency, they were treated with oligonucleotide using LIPOFECTIN® as described. When cells reached 65-75% confluency, they were treated with oligonucleotide. Oligonucleotide was mixed with LIPOFECTIN® Invitrogen Life Technologies, Carlsbad, Calif.) in Opti-MEMS-1 reduced serum medium (Invitrogen Life Technologies, Carlsbad, Calif.) to achieve the desired concentration of oligonucleotide and a LIPOFECTIN® concentration of 2.5- or 3 µg/mL per 100 nM oligonucleotide. This transfection mixture was incubated at room temperature for approximately 0.5 hours. For cells grown in 96-well plates, wells were washed once with 100 µL OPTI-MEM®-1 and then treated with 130 µL of the transfection mixture. Cells grown in 24-well plates or other standard tissue culture plates were treated similarly, using appropriate volumes of medium and oligonucleotide. Cells were treated and data were obtained in duplicate or triplicate. After approximately 4-7 hours of treatment at 37° C., the medium containing the transfection mixture was replaced with fresh culture medium. Cells were harvested 16-24 hours after oligonucleotide treatment.

Control oligonucleotides are used to determine the optimal oligomeric compound concentration for a particular cell line. Furthermore, when oligomeric compounds are tested in oligomeric compound screening experiments or phenotypic assays, control oligonucleotides are tested in parallel.

The concentration of oligonucleotide used varies from cell line to cell line. To determine the optimal oligonucleotide concentration for a particular cell line, the cells are treated with a positive control oligonucleotide at a range of concentrations. The concentration of positive control oligonucleotide that results in 80% inhibition of the target mRNA is then utilized as the screening concentration for new oligonucleotides in subsequent experiments for that cell line. If 80% inhibition is not achieved, the lowest concentration of positive control oligonucleotide that results in 60% inhibition of the target mRNA is then utilized as the oligonucleotide screening concentration in subsequent experiments for that cell line. If 60% inhibition is not achieved, that particular cell line is deemed as unsuitable for oligonucleotide transfection experiments. The concentrations of antisense oligonucleotides used herein are from 50 nM to 300 nM when the antisense oligonucleotide is transfected using a liposome reagent and 1 nM to 40 nM when the antisense oligonucleotide is transfected by electroporation.

Example 2

Real-time Quantitative PCR Analysis of Target mRNA Levels

Quantitation of target mRNA levels was accomplished by real-time quantitative PCR using the ABI PRISM® 7600, 7700, or 7900 Sequence Detection System (PE-Applied Biosystems, Foster City, Calif.) according to manufacturer's instructions.

Prior to quantitative PCR analysis, primer-probe sets specific to the target gene being measured were evaluated for their ability to be "multiplexed" with a GAPDH amplification reaction. After isolation the RNA is subjected to sequential reverse transcriptase (RT) reaction and real-time PCR, both of which are performed in the same well. RT and PCR reagents were obtained from Invitrogen Life Technologies (Carlsbad, Calif.). RT, real-time PCR was carried out in the same by adding 20 µL PCR cocktail (2.5×PCR buffer minus $MgCl_2$, 6.6 mM $MgCl_2$, 375 µM each of DATP, dCTP, dCTP and dGTP, 375 nM each of forward primer and reverse primer, 125 nM of probe, 4 Units RNAse inhibitor, 1.25 Units PLATINUM® Taq, 5 Units MuLV reverse transcriptase, and 2.5×ROX dye) to 96-well plates containing 30 µL total RNA solution (20-200 ng). The RT reaction was carried out by incubation for 30 minutes at 48° C. Following a 10 minute incubation at 95° C. to activate the PLATINUM® Taq, 40 cycles of a two-step PCR protocol were carried out: 95° C. for 15 seconds (denaturation) followed by 60° C. for 1.5 minutes (annealing/extension).

Gene target quantities obtained by RT, real-time PCR were normalized using either the expression level of GAPDH, a gene whose expression is constant, or by quantifying total RNA using RiboGreen® (Molecular Probes, Inc. Eugene, Oreg.). GAPDH expression was quantified by RT, real-time PCR, by being run simultaneously with the target, multiplexing, or separately. Total RNA was quantified using RiboGreen® RNA quantification reagent (Molecular Probes, Inc. Eugene, Oreg.).

170 µL of RiboGreen® working reagent (RiboGreen® reagent diluted 1:350 in 10 mM Tris-HCl, 1 mM EDTA, pH 7.5) was pipetted into a 96-well plate containing 30 µL purified cellular RNA. The plate was read in a CytoFluor 4000 (PE Applied Biosystems) with excitation at 485 nm and emission at 530 nm.

The GAPDH PCR probes have JOE covalently linked to the 5' end and TAMRA or MGB covalently linked to the 3' end, where JOE is the fluorescent reporter dye and TAMRA or MGB is the quencher dye. In some cell types, primers and probe designed to a GAPDH sequence from a different species are used to measure GAPDH expression. For example, a human GAPDH primer and probe set is used to measure GAPDH expression in monkey-derived cells and cell lines.

Probes and primers for use in real-time PCR were designed to hybridize to target nucleic acids using routine methods. For example, PrimerExpress® (Applied Biosystems, Foster City, Calif.) software is routinely used to design probes and primers for use in real-time PCR. Examples of primer and probe sequences and the target nucleic acids to which they hybridize are presented in Table 24. The target-specific PCR probes have FAM covalently linked to the 5' end and TAMRA or MGB covalently linked to the 3' end, where FAM is the fluorescent dye and TAMRA or MGB is the quencher dye.

TABLE 24

Target-specific primers and probes for use in real-time PCR

| Target Name | Species | Sequence Description | Sequence (5' to 3') | SEQ ID NO |
|---|---|---|---|---|
| ApoB | Mouse | Forward Primer | CGTGGGCTCCAGCATTCTA | 1524 |

TABLE 24-continued

Target-specific primers and probes for use in real-time PCR

| Target Name | Species | Sequence Description | Sequence (5' to 3') | SEQ ID NO |
|---|---|---|---|---|
| ApoB | Mouse | Reverse Primer | AGTCATTTCTGCCTTTGCGTC | 1525 |
| ApoB | Mouse | Probe | CCAATGGTCGGGCACTGCTCAA | 1526 |
| ApoB | Mouse | Forward Primer | GAAAATAGACTTCCTGAATAACTATGCATT | 1527 |
| ApoB | Mouse | Reverse Primer | ACTCGCTTGCCAGCTTGC | 1528 |
| ApoB | Mouse | Probe | TTTCTGAGTCCCCGTGCCCAACA | 1529 |
| GCGR | Mouse | Forward Primer | TGAGCCTTGCCACCTTCTCT | 1530 |
| GCGR | Mouse | Reverse Primer | GCGCACCCCAGCCAA | 1531 |
| GCGR | Mouse | Probe | AGAGGAGCTTCTTTTCCCTCTACCTGGGC | 1532 |
| GCGR | Mouse | Forward Primer | ATTTCCTGCCCCTGGTACCT | 1533 |
| GCGR | Mouse | Reverse Primer | CGGGCCCACACCTCTTG | 1534 |
| GCGR | Mouse | Probe | CCACAAAGTGCAGCACCGCCTAGTGT | 1535 |
| PTEN | Mouse | Forward Primer | GCCACAGGCTCCCAGACAT | 1536 |
| PTEN | Mouse | Reverse Primer | TCCATCCTCTTGATATCTCCTTTTG | 1537 |
| PTEN | Mouse | Probe | ACAGCCATCATCAAAGAGATCGTTAGCAGAA | 1538 |
| PTEN | Mouse | Forward Primer | ATGACAATCATGTTGCAGCAATTC | 1539 |
| PTEN | Mouse | Reverse Primer | CGATGCAATAAATATGCACAAATCA | 1540 |
| PTEN | Mouse | Probe | CTGTAAAGCTGGAAAGGGACGGACTGGT | 1541 |

Example 3

Short Antisense Compounds Targeted to an ApoB Nucleic Acid and having 2'-MOE or Methyleneoxy (4'-CH$_2$—O-2') BNA Modifications Six-week old male Balb/c mice (Jackson Laboratory, Bar Harbor, Me.) were injected intraperitoneally (i.p.) with antisense compounds targeted to ApoB, at a frequency of twice per week for three weeks. Antisense compound doses included 2.4, 1.2, 0.6, 0.3 and 0.15 µmol/kg. For antisense compounds 14 nucleotides in length, these doses equate to approximately 12, 6, 3, 1.5 or 0.75 mg/kg, respectively. Shown in Table 25 are the sequences and motifs of the antisense compounds used in this study. The antisense compounds are either 20 or 14 nucleotides in length and have a central "gap" region consisting of ten 2'-deoxynucleotides flanked by wings having 2'-O-methoxyethyl (2'-MOE) or BNA modified "wings." For example, the 2-10-2 MOE gapmer motif indicates an antisense compound with a gap of ten nucleotides flanked by 2 nucleotide wings with 2'-MOE modifications. Bolded residues indicate 2'-O-methoxyethyl moieties and italicized residues indicate methyleneoxy (4'-CH$_2$—O-2') BNAs. The internucleoside linkages of each compound are phosphorothioate throughout. All cytosine residues of ISIS 147764 and ISIS 372938 are replaced by 5-methyl cytosines. For ISIS 387462, only the cytosine residue in the wing of the compound is replaced by 5-methyl cytosine. ApoB antisense compounds are targeted to publicly available ApoB-100 sequences, including Genbank Accession No. XM_137955.5 (SEQ ID NO: 2).

TABLE 25

Antisense Compounds Targeted to an ApoB nucleic acid

| ISIS NO | Target SEQ ID NO | 5' Target Site | Sequence (5'-3') | Gapmer Motif | SEQ ID NO |
|---|---|---|---|---|---|
| 147764 | 2 | 8865 | GTCCCTGAAGATGTCAATGC | 5-10-5 MOE | 1561 |
| 372938 | 2 | 8235 | GGTACATGGAAGTC | 2-10-2 MOE | 190 |
| 387462 | 2 | 8235 | *GG*TACATGGAAG*TC* | 2-10-2 methyleneoxy (4'-CH$_2$-O-2') BNA | 190 |

Forty-eight hours following the final injection, mice were sacrificed to evaluate transaminases (Table 26); liver and kidney weight (Table 27); triglyceride, LDL, HDL and free fatty acid levels (Table 28); target mRNA level in liver (Table 29); target protein level in plasma; and oligonucleotide tissue concentration (Table 30). These endpoints were determined using methods described herein and well known to those of ordinary skill in the art.

TABLE 26

ALT and AST Levels (IU/L)

| ISIS NO | Dose µmol/kg | ALT | AST |
|---|---|---|---|
| Saline | N/A | 27.8 | 46.3 |
| 147764 | 2.4 | 29.5 | 64.0 |
| 372938 | 2.4 | 26.0 | 49.0 |
| 372938 | 1.2 | 24.8 | 49.5 |
| 372938 | 0.6 | 28.0 | 79.3 |
| 372938 | 0.3 | 28.3 | 60.0 |
| 372938 | 0.15 | 28.3 | 50.3 |
| 387462 | 2.4 | 41.3 | 84.0 |
| 387462 | 1.2 | 35.3 | 63.5 |
| 387462 | 0.6 | 32.0 | 77.3 |
| 387462 | 0.3 | 27.8 | 55.0 |
| 387462 | 0.15 | 29.3 | 68.3 |

TABLE 27

Liver and Kidney Weight (% of saline control)

| ISIS NO | Dose µmol/kg | Liver | Kidney |
|---|---|---|---|
| Saline | N/A | 100 | 100 |
| 147764 | 2.4 | 102 | 105 |
| 372938 | 2.4 | 100 | 100 |
| 372938 | 1.2 | 90 | 101 |
| 372938 | 0.6 | 96 | 112 |
| 372938 | 0.3 | 91 | 107 |
| 372938 | 0.15 | 96 | 98 |
| 387462 | 2.4 | 116 | 90 |
| 387462 | 1.2 | 113 | 90 |
| 387462 | 0.6 | 106 | 97 |
| 387462 | 0.3 | 101 | 126 |
| 387462 | 0.15 | 95 | 100 |

Total body weight and food consumption did not differ significantly between saline-treated or oligonucleotide-treated animals. Glucose levels also were similar among all treatment groups.

TABLE 28

Triglyceride (TRIG), Total Cholesterol (CHOL), HDL, LDL and Free Fatty Acid (FFA) Levels

| ISIS NO | Dose µmol/kg | TRIG (mg/dL) | CHOL (mg/dL) | HDL (mg/dL) | LDL (mg/dL) | FFA (mg/dL) |
|---|---|---|---|---|---|---|
| Saline | N/A | 167 | 107 | 81.8 | 11.0 | 1.76 |
| 147764 | 2.4 | 167 | 107 | 81.3 | 10.3 | 1.29 |
| 372938 | 2.4 | 153 | 104 | 79.0 | 10.3 | 1.28 |
| 372938 | 1.2 | 136 | 101 | 77.8 | 9.5 | 1.70 |
| 372938 | 0.6 | 184 | 110 | 83.3 | 10.8 | 1.66 |
| 372938 | 0.3 | 138 | 109 | 84.3 | 11.0 | 1.53 |
| 372938 | 0.15 | 151 | 106 | 82.8 | 10.8 | 1.57 |
| 387462 | 2.4 | 49 | 14 | 9.0 | 1.5 | 0.74 |
| 387462 | 1.2 | 71 | 23 | 16.5 | 2.0 | 0.76 |
| 387462 | 0.6 | 150 | 55 | 39.3 | 3.7 | 1.43 |
| 387462 | 0.3 | 136 | 92 | 72.8 | 7.5 | 1.14 |
| 387462 | 0.15 | 163 | 104 | 81.5 | 9.3 | 1.47 |

TABLE 29

% ApoB mRNA Level (relative to saline control)

| ISIS NO | 2.4 µmol/kg | 1.2 µmol/kg | 0.6 µmol/kg | 0.3 µmol/kg | 0.15 µmol/kg |
|---|---|---|---|---|---|
| 147764 | 57.7 | ND | ND | ND | ND |
| 372938 | 77.0 | 90.0 | 87.3 | 92.6 | 93.1 |
| 387462 | 1.5 | 8.5 | 27.4 | 58.9 | 75.8 |

Treatment with ISIS 387462 resulted in a significant and dose-dependent decrease in triglycerides, total cholesterol, HDL, LDL and free fatty acids. In accordance with these phenotypic findings, treatment with ISIS 387462 also led to a dose-dependent reduction in ApoB mRNA (Table 29) and protein (not shown) levels in mouse plasma. To determine whether the observed increase in efficiency with the methyleneoxy (4'-CH$_2$—O-2') BNA gapmer is due to an increase in oligonucleotide accumulation, full-length and total oligonucleotide concentration in the liver and kidney were determined.

TABLE 30

Full-length and Total Antisense Compound Tissue Concentration (µM) Relative to ApoB mRNA level (% of saline control)

| ISIS NO | Dose µmol/kg | Kidney Full-Length | Liver Full-Length | Kidney Total | Liver Total | ApoB mRNA |
|---|---|---|---|---|---|---|
| 147764 | 2.4 | 28.6 | 22.9 | 33.5 | 31.3 | 58 |
| 372938 | 2.4 | 32.0 | 5.49 | 34.0 | 7.76 | 77 |

TABLE 30-continued

Full-length and Total Antisense Compound Tissue Concentration
(μM) Relative to ApoB mRNA level (% of saline control)

| ISIS NO | Dose μmol/kg | Kidney Full-Length | Liver Full-Length | Kidney Total | Liver Total | ApoB mRNA |
|---|---|---|---|---|---|---|
| 387462 | 2.4 | 37.2 | 5.69 | 38.9 | 7.31 | 1.5 |
| 387462 | 1.2 | 29.8 | 3.71 | 31.3 | 4.91 | 8.5 |
| 387462 | 0.6 | 18.9 | 1.97 | 20.0 | 2.57 | 27 |
| 387462 | 0.3 | 9.11 | 0.73 | 9.49 | 0.78 | 59 |
| 387462 | 0.15 | 6.97 | 0.19 | 7.43 | 0.24 | 76 |

Levels of the 2-10-2 methyleneoxy (4'-CH$_2$—O-2') BNA gapmer were similar to the 5-10-5 and 2-10-2 MOE gapmers in the kidney, but significantly reduced in the liver. The EC$_{50}$ for ISIS 387462 in the liver was determined by comparing oligonucleotide concentration in the liver to inhibition of ApoB mRNA. The approximate EC$_{50}$ for ISIS 387462 is 1 μM. In contrast, an effective 5-10-5 MOE gapmer compound typically has an EC$_{50}$ of approximately 15 μM in the liver.

Taken together, these results demonstrate that the ApoB short gapmer having methyleneoxy (4'-CH$_2$—O-2') in the wings is a potent inhibitor of target mRNA expression and can effectively lower triglycerides, cholesterol and free fatty acids. The potency of the short antisense compound does not appear to be a result of increased tissue accumulation since similar levels of the compound were observed in kidney and reduced levels were found in the liver, relative to the 5-10-5 MOE gapmer. In addition, the methyleneoxy (4'-CH$_2$—O-2') BNA gapmer exhibited little to no adverse side effects.

Example 4

Short Antisense Compounds Targeted to a GCGR Nucleic Acid and Having 2'-MOE Modifications Eight-week old male C57/BL6 mice (Jackson Laboratory, Bar Harbor, Me.) were administered a single dose of GCGR oligonucleotide by intraperitoneal injection at a concentration of 6.25, 12.5, 25 or 50 mg. Each dose group consisted of four animals. Shown in Table 31 are the sequences, motifs and conjugates of the GCGR antisense compounds used in this study. Bolded residues indicate 2'-O-methoxyethyl (2'-MOE) moieties. All compounds comprise phosphorothioate internucleoside linkages throughout and each cytosine is replaced with 5-methylcytosine. ISIS 386626, ISIS 386627 and ISIS 386628 further comprise a C$_{16}$ conjugate group attached to the 2'-O position of the sugar via a diamide linkage (2'-OCH$_2$C(═O)N(H)(CH$_2$)$_4$N(H)C(═O)—(CH$_2$)$_{15}$CH$_3$).

GCGR antisense compounds target published GCGR sequences, including Genbank® Accession No. BC031885.1 (SEQ ID NO: 7).

TABLE 31

Short antisense compounds targeted to a GCGR nucleic acid

| ISIS NO | Target SEQ ID NO | 5' Target Site | Sequence (5'-3') | Gapmer Motif | Conjugate | SEQ ID NO |
|---|---|---|---|---|---|---|
| 148364 | 7 | 393 | TGCACTTTGTGGTACCAAGG | 5-10-5 MOE | None | 1562 |
| 386626 | 7 | 1768 | G$_{C16}$CTTCTCCATCATA | 2-10-2 MOE | C16 | 1563 |
| 386627 | 7 | 1244 | G$_{C16}$GGCATGCTCGTCA | 2-10-2 MOE | C16 | 653 |
| 386593 | 7 | 1244 | GGGCATGCTCGTCA | 2-10-2 MOE | None | 649 |
| 386628 | 7 | 1680 | T$_{C16}$GTCTTGCTGCTTT | 2-10-2 MOE | C16 | 1564 |
| 386594 | 7 | 1680 | TGTCTTGCTGCTTT | 2-10-2 MOE | None | 1565 |

Mice were sacrificed 48 hours following injection to determine serum transaminase levels (Table 32); liver, white adipose tissue (WAT), spleen and kidney weight (Table 33); cholesterol, triglyceride and glucose levels (Table 34); GCGR mRNA levels (Tables 35-41); and full-length and total oligonucleotide concentration in liver and kidney (Table 42). Endpoints were assessed using methods described herein and well known to those of ordinary skill in the art. Data is included from a pre-treatment bleed (Pre-Bleed) and post-treatment bleed (Post-Bleed).

TABLE 32

ALT & AST Levels (IU/L)

| ISIS NO | Dose (mg/kg) | ALT Pre-Bleed | ALT Post-Bleed | AST Pre-Bleed | AST Post-Bleed |
|---|---|---|---|---|---|
| Saline | N/A | 36 | 51 | 55 | 85 |
| 148364 | 50 | 24 | 40 | 40 | 115 |
| 148364 | 25 | 26 | 35 | 42 | 87 |
| 148364 | 12.5 | 23 | 32 | 44 | 69 |
| 148364 | 6.25 | 28 | 34 | 47 | 76 |
| 386626 | 50 | 28 | 40 | 48 | 120 |
| 386626 | 25 | 30 | 36 | 44 | 92 |
| 386626 | 12.5 | 28 | 34 | 44 | 90 |
| 386626 | 6.25 | 26 | 42 | 46 | 69 |
| 386627 | 50 | 27 | 457 | 42 | 451 |
| 386627 | 25 | 29 | 97 | 45 | 142 |
| 386627 | 12.5 | 29 | 62 | 46 | 81 |
| 386627 | 6.25 | 23 | 87 | 38 | 96 |
| 386593 | 50 | 23 | 33 | 46 | 58 |
| 386593 | 25 | 25 | 32 | 41 | 95 |
| 386593 | 12.5 | 26 | 33 | 43 | 74 |
| 386593 | 6.25 | 28 | 31 | 43 | 53 |
| 386628 | 50 | 28 | 68 | 44 | 76 |
| 386628 | 25 | 24 | 32 | 40 | 57 |

TABLE 32-continued

ALT & AST Levels (IU/L)

| ISIS NO | Dose (mg/kg) | ALT Pre-Bleed | ALT Post-Bleed | AST Pre-Bleed | AST Post-Bleed |
|---|---|---|---|---|---|
| 386628 | 12.5 | 28 | 35 | 42 | 75 |
| 386628 | 6.25 | 22 | 29 | 40 | 59 |
| 386594 | 50 | 29 | 34 | 46 | 92 |
| 386594 | 25 | 27 | 31 | 47 | 82 |
| 386594 | 12.5 | 28 | 33 | 45 | 74 |
| 386594 | 6.25 | 23 | 48 | 42 | 67 |

TABLE 33

Organ Weights (% saline control)

| ISIS NO | Dose (mg/kg) | Liver | WAT | Kidney | Spleen |
|---|---|---|---|---|---|
| Saline | N/A | 100 | 100 | 100 | 100 |
| 148364 | 50 | 103 | 80 | 108 | 123 |
| 148364 | 25 | 103 | 75 | 112 | 115 |
| 148364 | 12.5 | 100 | 84 | 108 | 96 |
| 148364 | 6.25 | 101 | 89 | 104 | 113 |
| 386626 | 50 | 112 | 77 | 104 | 130 |
| 386626 | 25 | 109 | 97 | 103 | 120 |
| 386626 | 12.5 | 96 | 73 | 97 | 114 |
| 386626 | 6.25 | 100 | 90 | 100 | 95 |
| 386627 | 50 | 90 | 113 | 102 | 165 |
| 386627 | 25 | 99 | 87 | 99 | 143 |
| 386627 | 12.5 | 109 | 93 | 102 | 136 |
| 386627 | 6.25 | 103 | 96 | 102 | 131 |
| 386593 | 50 | 96 | 98 | 102 | 118 |
| 386593 | 25 | 83 | 94 | 100 | 104 |
| 386593 | 12.5 | 99 | 82 | 101 | 129 |
| 386593 | 6.25 | 96 | 77 | 98 | 144 |
| 386628 | 50 | 104 | 100 | 99 | 126 |
| 386628 | 25 | 102 | 97 | 109 | 113 |
| 386628 | 12.5 | 101 | 111 | 99 | 114 |
| 386628 | 6.25 | 98 | 106 | 102 | 151 |
| 386594 | 50 | 90 | 80 | 99 | 131 |
| 386594 | 25 | 93 | 76 | 99 | 128 |
| 386594 | 12.5 | 94 | 98 | 100 | 113 |
| 386594 | 6.25 | 102 | 85 | 101 | 119 |

Overall, the GCGR antisense compounds exhibited little to no adverse side effects.

TABLE 34

Triglyceride (TRIG), Cholesterol (CHOL) and Glucose Levels (IU/L)

| ISIS NO | Dose (mg/kg) | TRIG Pre-Bleed | TRIG Post-Bleed | CHOL Pre-Bleed | CHOL Post-Bleed | Glucose Pre-Bleed | Glucose Post-Bleed |
|---|---|---|---|---|---|---|---|
| Saline | N/A | 132 | 181 | 91 | 96 | 208 | 285 |
| 148364 | 50 | 110 | 177 | 81 | 94 | 207 | 228 |
| 148364 | 25 | 115 | 200 | 83 | 96 | 219 | 239 |
| 148364 | 12.5 | 106 | 179 | 85 | 89 | 198 | 256 |
| 148364 | 6.25 | 86 | 162 | 86 | 89 | 226 | 215 |
| 386626 | 50 | 87 | 163 | 79 | 57 | 239 | 179 |
| 386626 | 25 | 100 | 187 | 87 | 72 | 235 | 186 |
| 386626 | 12.5 | 100 | 148 | 82 | 76 | 232 | 185 |
| 386626 | 6.25 | 86 | 162 | 85 | 90 | 222 | 221 |
| 386627 | 50 | 106 | 120 | 83 | 126 | 227 | 150 |
| 386627 | 25 | 101 | 148 | 90 | 115 | 218 | 203 |
| 386627 | 12.5 | 99 | 203 | 86 | 98 | 237 | 219 |
| 386627 | 6.25 | 111 | 165 | 88 | 104 | 238 | 228 |
| 386593 | 50 | 130 | 128 | 100 | 95 | 244 | 213 |
| 386593 | 25 | 119 | 135 | 83 | 77 | 206 | 208 |
| 386593 | 12.5 | 122 | 128 | 83 | 79 | 222 | 233 |
| 386593 | 6.25 | 120 | 138 | 84 | 78 | 214 | 219 |
| 386628 | 50 | 102 | 98 | 88 | 95 | 209 | 232 |
| 386628 | 25 | 102 | 129 | 84 | 85 | 210 | 223 |
| 386628 | 12.5 | 90 | 123 | 90 | 94 | 231 | 240 |
| 386628 | 6.25 | 117 | 121 | 83 | 85 | 228 | 229 |
| 386594 | 50 | 93 | 99 | 84 | 85 | 203 | 274 |
| 386594 | 25 | 106 | 94 | 90 | 86 | 219 | 272 |
| 386594 | 12.5 | 118 | 133 | 85 | 95 | 200 | 292 |
| 386594 | 6.25 | 112 | 146 | 78 | 94 | 222 | 275 |

GCGR 2-10-2 MOE gapmers exhibited a trend toward lower post-bleed triglyceride levels, relative to the 5-10-5 MOE gapmer, with ISIS 386628 and ISIS 386594 having the greatest dose-dependent effect. Glucose levels also were decreased in a dose-dependent manner following treatment with ISIS 386626 and ISIS 386627. Treatment with ISIS 386628, ISIS 386593 and ISIS 386594 also generally led to a decrease in post-bleed glucose levels. Cholesterol levels did not appear to significantly differ among treatment groups.

To determine whether the phenotypic changes shown above correlated with a decrease in GCGR mRNA, treated animals were evaluated for levels of target mRNA in liver by real time PCR according to methods described herein. Tables 35 to 41 show results from direct comparisons of the antisense compounds targeting GCGR nucleic acid for their effect on target expression. Results are expressed as percent of saline control.

TABLE 35

GCGR mRNA levels following treatment with
ISIS 148364 & ISIS 386626

| ISIS NO | 50 mg/kg | 25 mg/kg | 12.5 mg/kg | 6.25 mg/kg |
|---|---|---|---|---|
| 148364 | 36 | 79 | 87 | 62 |
| 386626 | 0 | 8 | 3 | 7 |

TABLE 36

GCGR mRNA levels following treatment with
ISIS 148364 & ISIS 386627

| ISIS NO | 50 mg/kg | 25 mg/kg | 12.5 mg/kg | 6.25 mg/kg |
|---|---|---|---|---|
| 148364 | 63 | 87 | 105 | 86 |
| 386627 | 3 | 30 | 57 | 74 |

TABLE 37

GCGR mRNA levels following treatment with
ISIS 148364 & ISIS 386593

| ISIS NO | 50 mg/kg | 25 mg/kg | 12.5 mg/kg | 6.25 mg/kg |
|---|---|---|---|---|
| 148364 | 56 | 74 | 105 | 86 |
| 386593 | 9 | 38 | 74 | 90 |

TABLE 38

GCGR mRNA levels following treatment with
ISIS 148364 & ISIS 386628

| ISIS NO | 50 mg/kg | 25 mg/kg | 12.5 mg/kg | 6.25 mg/kg |
|---|---|---|---|---|
| 148364 | 42 | 77 | 98 | 101 |
| 386628 | 2 | 18 | 53 | 77 |

TABLE 39

GCGR mRNA levels following treatment with
ISIS 148364 & ISIS 386594

| ISIS NO | 50 mg/kg | 25 mg/kg | 12.5 mg/kg | 6.25 mg/kg |
|---|---|---|---|---|
| 148364 | 59 | 98 | 102 | 96 |
| 386594 | 25 | 47 | 50 | 96 |

TABLE 40

GCGR mRNA levels following treatment with
ISIS 386627 & ISIS 386593

| ISIS NO | 50 mg/kg | 25 mg/kg | 12.5 mg/kg | 6.25 mg/kg |
|---|---|---|---|---|
| 386627 | 5 | 40 | 58 | 42 |
| 386593 | 10 | 29 | 34 | 71 |

TABLE 41

GCGR mRNA levels following treatment with
ISIS 386628 & ISIS 386594

| ISIS NO | 50 mg/kg | 25 mg/kg | 12.5 mg/kg | 6.25 mg/kg |
|---|---|---|---|---|
| 386628 | 4 | 13 | 38 | 97 |
| 386594 | 19 | 50 | 56 | 99 |

Treatment with the 2-10-2 MOE gapmers led to a significant dose-dependent decrease in GCGR mRNA expression. ISIS 386626 exhibited the greatest decrease in target mRNA. To determine whether the observed increase in efficiency with the short antisense compounds is due to an increase in antisense compound accumulation, full-length and total antisense compound concentration in the liver and kidney were determined.

TABLE 42

Total and Full-length Antisense Compound
Concentrations in Liver and Kidney (µg/g)

| ISIS NO | Total Kidney | Total Liver | Full-length Kidney | Full-length Liver |
|---|---|---|---|---|
| 148364 | 90 | 54 | 58 | 46 |
| 386626 | 757 | 274 | 355 | 125 |
| 386593 | 91 | 12 | 77 | 12 |
| 386628 | 496 | 286 | 305 | 202 |

The results shown in Table 42 demonstrate that short antisense compounds comprising a $C_{16}$ conjugate exhibit a significant increase in antisense compound accumulation in both liver and kidney. However, ISIS 386593, which was effective at reducing target mRNA, triglycerides and glucose levels, accumulates to a level similar to the 5-10-5 MOE gapmer in liver and to a lower level in kidney. These results suggest that while conjugation with $C_{16}$ can increase liver and kidney antisense compound concentration, it does not entirely account for the effectiveness of the short antisense compounds.

Taken together, these results demonstrate that GCGR short antisense compounds are capable of significantly inhibiting target mRNA expression while also lowering triglyceride and glucose levels. In addition, with the exception of ISIS 386627, the short MOE gapmers exhibited little to no toxic effects.

Example 5

Short Antisense Compounds Targeting to a GCGR Nucleic Acid and Having 2'-MOE and Methyleneoxy (4'-CH$_2$—O-2') BNA Modifications Eight-week old male C57/BL6 mice (Jackson Laboratory, Bar Harbor, Me.) were administered a single dose of GCGR antisense compound by intraperitonel (i.p.) injection at a concentration of 10, 3.2, 1, and 0.32 µmol·kg. Each dose group consisted of four animals. Shown in Table 43 are the sequences, motifs and conjugates of the GCGR antisense compounds used in this study. Bolded residues indicate 2'-O-methoxyethyl (2'-MOE) modifications and the italicized residues indicate methyleneoxy (4'-CH$_2$—O-2') BNA modifications. All antisense compounds comprise phosphorothioate internucleoside linkages throughout and each cytosine is replaced with 5-methylcytosine. GCGR antisense compounds target published GCGR nucleic acids, including Genbank Accession No. BC031885.1 (SEQ ID NO: 7).

TABLE 43

Antisense Compounds targeted to a GCGR nucleic acid

| ISIS NO | Target SEQ ID NO | 5' Target Site | Sequence (5'-3') | Gapmer Motif | SEQ ID NO |
|---|---|---|---|---|---|
| 148364 | 7 | 393 | TGCACTTTGTGGTACCAAGG | 5-10-5 MOE | 1562 |
| 396144 | 7 | 1768 | GCTTCTCCATCATA | 2-10-2 MOE | 1566 |
| 396148 | 7 | 1768 | *GC*TTCTCCATC*ATA* | 2-10-2 Methyleneoxy (4'-CH$_2$-O-2') BNA | 1567 |
| 396145 | 7 | 1765 | ATGGCTTCTCCATCATATCC | 5-10-5 MOE | 1568 |
| 396146 | 7 | 1244 | GGGCATGCTCGTCA | 2-10-2 MOE | 650 |
| 396149 | 7 | 1244 | *GG*GCATGCTCG*TCA* | 2-10-2 Methyleneoxy (4'-CH$_2$-O-2') BNA | 652 |
| 396147 | 7 | 1241 | CTTGGGCATGCTCGTCAGTC | 5-10-5 MOE | 1569 |

To determine whether the phenotypic changes shown above correlated with a decrease in GCGR mRNA, treated animals were evaluated for levels of target mRNA in liver by RT, real time PCR according to methods described herein. Table 44 show results from direct comparisons of the antisense compounds targeting GCGR nucleic acid for their effect on target expression. Results are expressed as percent of saline control.

TABLE 44

GCGR mRNA levels

| ISIS NO. | 0.32 µmol/kg | 1 µmol/kg | 3.2 µmol/kg | 10 µmol/kg |
|---|---|---|---|---|
| 148364 | 105 | 106 | 73 | 38 |
| 396144 | 122 | 117 | 40 | 35 |
| 396148 | 20 | 6 | 2 | 1 |
| 396145 | nd | Nd | 33 | 8 |
| 396146 | 98 | 135 | 95 | 35 |
| 396149 | 91 | 41 | 30 | 7 |
| 396147 | nd | Nd | 68 | 28 |

As shown in Table 44, each short antisense compound having methyleneoxy (4'-CH$_2$—O-2') BNA modifications demonstrated a dose-dependent reduction in GCGR mRNA levels. Furthermore, the short antisense compounds were more effective at target reduction than the 5-10-5 MOE gapmer. Each short antisense compound comprising methyleneoxy (4'-CH$_2$—O-2') BNA in the wings resulted in a significant reduction in GCGR protein relative to both saline control and ISIS 148364 treatment. Next, estimated ED$_{50}$ concentrations for each antisense were calculated using Graphpad Prism; ED$_{50}$ is the dose at which 50% mRNA reduction is observed. The results are shown below in Table 45.

TABLE 45

Estimated ED$_{50}$ Concentration

| Gapmer Motif | ISIS NO | ED$_{50}$ (µmole/kg) | ED$_{50}$ (mg/kg) |
|---|---|---|---|
| 5-10-5 MOE | 148364 | 7 | 50.6 |
| 2-10-2 MOE | 396144 | 4 | 18.1 |
| 2-10-2 methyleneoxy BNA | 396148 | 0.1 | 0.4 |
| 5-10-5 MOE | 396145 | 2.1 | 9.3 |
| 2-10-2 MOE | 396146 | 8.3 | 40 |
| 2-10-2 methylenexy BNA | 396149 | 1.1 | 5 |
| 5-10-5 MOE | 396147 | 5.2 | 37.5 |

Example 6

Short Antisense Compounds Targeting a PTEN Nucleic Acid and Having Methyleneoxy (4'-CH$_2$—O-2') BNA Modifications Six-week old male Balb/c mice (Jackson Laboratory, Bar Harbor, Me.) were administered a single i.p. injection of PTEN antisense compound at a dose of 8 µmol/kg. Each dose group consisted of four animals. Shown in Table 46 are the sequences and motifs of the PTEN antisense compounds used in this study. Bolded residues indicate 2'-O-methoxyethyl moieties (2'-MOE) and italicized residues indicate Methyleneoxy BNA nucleotides. Each antisense compound comprises phosphorothioate linkages throughout. In addition, the cytosine residues in the gap of ISIS 384073 and in the wings of ISIS 392056, ISIS 392057, ISIS 392061 and ISIS 392063 are replaced with 5-methylcytosines. Antisense compounds target published PTEN nucleic acids, including Genbank Accession No. U92437.1 (SEQ ID NO: 13).

TABLE 46

Antisense Compounds targeted to a PTEN nucleic acid

| ISIS NO | Target SEQ ID NO | 5' Target Site | Sequence (5'-3') | Gapmer Motif | SEQ ID NO |
|---|---|---|---|---|---|
| 141923 | Control | N/A | CCTTCCCTGAAGGTTCCTCC | 5-10-5 MOE | 1570 |
| 116847 | 29 | 2011 | TCAAATCCAGAGGCTAGCAG | 5-10-5 MOE | 1571 |
| 384073 | 29 | 2013 | *AAA*TCCAGAGGCT*AGC* | 3-10-3 methyleneoxy (4'-CH$_2$-O-2') BNA | 1428 |
| 391172 | 29 | 2013 | *AA*ATCCAGAGGCT*AG* | 2-10-3 methyleneoxy (4'-CH$_2$-O-2') BNA | 1429 |
| 392056 | 29 | 140 | *AG*CTGCAGCCAT*GA* | 2-10-2 methyleneoxy (4'-CH$_2$-O-2') BNA | 1263 |
| 392057 | 29 | 807 | *GG*TCCAGGGCCA*AG* | 2-10-2 methyleneoxy (4'-CH$_2$-O-2') BNA | 1162 |
| 392061 | 29 | 2014 | *AA*TCCAGAGGCT*AG* | 2-10-2 methy (4'-CH$_2$-O-2') BNA | 1431 |
| 392063 | 29 | 3099 | *AG*GCCAGTGCTA*AG* | 2-10-2 methymethyleneoxy (4'-CH$_2$-O-2') BNA | 1226 |

Mice were sacrificed 72 hours following injection to determine serum transaminase levels (Table 47); liver and spleen weights (Table 47); and PTEN mRNA levels in liver, kidney and fat (Table 48), according to procedures described herein and well know to one of ordinary skill in the art.

TABLE 47

Transaminase Levels and Organ Weights

| ISIS NO | AST (IU/L) | ALT (IU/L) | Liver Weight % Saline | Spleen Weight % Saline |
|---|---|---|---|---|
| Saline | 98.5 | 37.5 | 100 | 100 |
| 141923 | 89.5 | 34.8 | 101 | 108 |
| 116847 | 59.8 | 29.5 | 109 | 108 |
| 384073 | 57.8 | 29.3 | 115 | 111 |
| 391172 | 48.5 | 32.8 | 120 | 112 |
| 392056 | 516 | 892 | 125 | 167 |
| 392057 | 63.8 | 34.5 | 125 | 101 |
| 392061 | 189 | 42.0 | 123 | 111 |
| 392063 | 67.3 | 21.8 | 127 | 134 |

Overall, the short antisense compounds with methyleneoxy (4'-CH$_2$—O-2') BNA modifications exhibited little to no adverse effects. In addition, total body weight did not significantly differ between treatment groups.

TABLE 48

% PTEN mRNA levels in Liver, Kidney and Fat

| ISIS NO | Liver | Kidney | Fat |
|---|---|---|---|
| Saline | 100 | 100 | 100 |
| 141923 | 102 | 133 | 118 |
| 116847 | 37 | 96 | 85 |
| 384073 | 24 | 74 | 77 |
| 391172 | 18 | 63 | 101 |
| 392056 | 27 | 88 | 74 |
| 392057 | 33 | 79 | 96 |
| 392061 | 24 | 61 | 85 |
| 392063 | 6.5 | 52 | 72 |

As shown in Table 48, each antisense compound targeted to a PTEN nucleic acid led to a significant reduction in target mRNA levels in liver as compared with saline treated and control treated animals. The antisense compounds had various effects on target mRNA levels in kidney and fat.

Example 7

Short Antisense Compounds Targeting a PTEN Nucleic Acid and having BNA Modifications Six-week old male Balb/c mice (Jackson Laboratory, Bar Harbor, Me.) were administered a single intraperitoneal (i.p.) injection of antisense compound targeted a PTEN nucleic acid at a dose of 8, 4, 2 or 1 µmol/kg. Each dose group consisted of four animals. Shown in Table 49 are the sequence, wing chemistry and motif of each antisense compound used in this study. Bold residues indicate 2'-MOE modified nucleotides, italicized letters indicate methyleneoxy (4'-CH$_2$—O-2') BNA modifications. All antisense compounds comprise phosphorothioate linkages at each position. Each cytosine of ISIS 116847 and the cytosine residues in the methyleneoxy (4'-CH$_2$—O-2') BNA wings of ISIS 392063 are replaced with 5-methylcytosines, while the thymidine residues in the methyleneoxy (4'-CH$_2$—O-2') BNA wings of ISIS 392745 are replaced with 5-methyl thymidines. Antisense compounds target published PTEN nucleic acids, including Genbank Accession No. U92437.1 (SEQ ID NO: 13).

TABLE 49

Antisense Compounds Targeted to a PTEN Nucleic Acid

| ISIS NO | Target SEQ ID NO | 5' Target Site | Sequence (5'-3') | Gapmer Motif | SEQ ID NO |
|---|---|---|---|---|---|
| 116847 | 13 | 2011 | TCAAATCCAGAGGCTAGCAG | 5-10-5 MOE | 1571 |
| 392063 | 13 | 3099 | CTTAGCACTGGCCT | 2-10-2 Methyleneoxy BNA | 1226 |
| 392745 | 13 | 3099 | CTTAGCACTGGCCT | 2-10-2 methyleneoxy BNA | 1226 |

Mice were sacrificed 72 hours following injection to determine serum transaminase levels (Table 50); liver, kidney and spleen weights (Table 50); PTEN mRNA levels in liver (Table 51); and estimated $ED_{50}$ oligonucleotide concentration (Table 52). These endpoints were measured using methods described herein and well known to those of ordinary skill in the art.

TABLE 50

AST, ALT and Bilirubin Levels and Organ Weights

| ISIS NO | Dose µmol/kg | AST (IU/L) | ALT (IU/L) | Bilirubin (mg/dL) | Liver Weight % Saline | Kidney Weight % Saline | Spleen Weight % Saline |
|---|---|---|---|---|---|---|---|
| Saline | N/A | 64.0 | 31.8 | 0.15 | 100 | 100 | 100 |
| 116847 | 8 | 73.0 | 32.0 | 0.1 | 114 | 92 | 106 |
| 392063 | 8 | 50.3 | 17.3 | 0.1 | 115 | 98 | 115 |
| 392063 | 4 | 100.8 | 31.3 | 0.15 | 122 | 94 | 116 |
| 392063 | 2 | 60.5 | 32.8 | 0.1 | 112 | 99 | 106 |
| 392063 | 1 | 57.5 | 29.3 | 0.1 | 104 | 95 | 107 |
| 392745 | 8 | 75.5 | 23.5 | 0.13 | 125 | 99 | 100 |
| 392745 | 4 | 77.0 | 29.3 | 0.13 | 121 | 100 | 96 |
| 392745 | 2 | 69.0 | 32.0 | 0.13 | 110 | 98 | 103 |
| 392745 | 1 | 52.0 | 27.3 | 0.1 | 109 | 97 | 104 |

Overall, the PTEN antisense compounds did not show significant signs of toxicity. Kidney, liver and spleen weights were all within normal ranges. Total body weight did not significantly differ between treatment groups.

TABLE 51

% PTEN mRNA levels in Liver (relative to saline control)

| ISIS NO | 8 µmol/kg | 4 µmol/kg | 2 µmol/kg | 1 µmol/kg |
|---|---|---|---|---|
| 116847 | 36 | ND | ND | ND |
| 392063 | 7.4 | 16 | 32 | 60 |
| 392745 | 5.2 | 11 | 31 | 60 |

As shown in Table 51, each short antisense compound having methyleneoxy (4'-CH$_2$—O-2') BNA modifications demonstrated a dose-dependent reduction in PTEN mRNA levels. Furthermore, the short antisense compounds were more effective at target reduction than the 5-10-5 MOE gapmer. Levels of PTEN protein in liver were also determined following administration of each antisense compound at a dose of 8 µmol/kg. Each short antisense compound comprising methyleneoxy (4'-CH$_2$—O-2') BNA in the wings resulted in a significant reduction in PTEN protein relative to both saline control and ISIS 116847 treatment. Next, estimated $ED_{50}$ concentrations for each oligonucleotide were calculated using Graphpad Prism. The results are shown below in Table 52.

TABLE 52

Estimated $ED_{50}$ Concentration

| Wing Chemistry | ISIS NO | $ED_{50}$ (µmole/kg) | $ED_{50}$ (mg/kg) |
|---|---|---|---|
| MOE (with 5-MeC) | 116847 | 6.3 | 45.2 |
| methyleneoxy BNA (with 5-MeC) | 392063 | 1.3 | 5.8 |
| methyleneoxy BNA | 392745 | 1.2 | 5.6 |

To further investigate different types of bicyclic nucleic acid compounds, an additional set of short antisense compounds targeting a PTEN nucleic acid was designed and tested. Six-week old male Balb/c mice (Jackson Laboratory, Bar Harbor, Me.) were administered a single intraperitoneal (i.p.) injection of antisense compound at a dose of 8, 4, 2 or 1 µmol/kg. Each dose group consisted of four animals. Shown in Table 53 are the sequence, wing chemistry and motif of each antisense compound used in this study. All antisense compounds comprise phosphorothioate linkages at each position. The cytosine residues in the methyleneoxy (4'-CH$_2$—O-2') BNA wings of ISIS 392063 are replaced with 5-methylcytosines. The antisense compound target published PTEN nucleic acids, including Genbank Accession No. U92437.1 (SEQ ID NO: 13).

TABLE 53

Antisense Compounds Targeting a PTEN Nucleic Acid

| ISIS NO | Target SEQ ID NO | 5' Target Site | Sequence (5'-3') | Gapmer Motif | SEQ ID NO |
|---|---|---|---|---|---|
| 392063 | 29 | 3099 | CTTAGCACTGGCCT | 2-10-2 Methyleneoxy BNA | 1226 |
| 396564 | 29 | 3099 | CTTAGCACTGGCCT | 2-10-2 Oxyamino (4'-CH$_2$–N(R)—O-2') BNA | 1226 |
| 396006 | 29 | 3099 | CTTAGCACTGGCCT | 2-10-2α-L-Methyleneoxy BNA | 1226 |

Mice were sacrificed 72 hours following injection to determine serum transaminase levels (Table 54); liver and spleen weights (Table 54); and PTEN mRNA levels in liver (Table 55), according to methods described herein and well known to those of ordinary skill in the art.

TABLE 54

AST and ALT Levels and Organ Weights

| ISIS NO | Dose μmol/kg | AST (IU/L) | ALT (IU/L) | Liver Weight | Spleen Weight |
|---|---|---|---|---|---|
| Saline | N/A | 71 | 33 | 100 | 100 |
| 392063 | 8 | 97 | 38 | 118 | 103 |
| 392063 | 4 | 179 | 36 | 115 | 107 |
| 392063 | 2 | 67 | 32 | 109 | 116 |
| 392063 | 1 | 68 | 27 | 102 | 105 |
| 396564 | 8 | 67 | 25 | 100 | 104 |
| 396564 | 4 | 96 | 30 | 102 | 106 |
| 396564 | 2 | 68 | 27 | 100 | 119 |
| 396564 | 1 | 79 | 39 | 97 | 109 |
| 396006 | 8 | 56 | 28 | 110 | 104 |
| 396006 | 2 | 139 | 36 | 97 | 105 |

TABLE 55

% PTEN mRNA levels in Liver (relative to saline control)

| ISIS NO | 8 μmol/kg | 4 μmol/kg | 2 μmol/kg | 1 μmol/kg |
|---|---|---|---|---|
| 392063 | 6.9 | 18 | 39 | 71 |
| 396564 | 86 | 97 | 100 | 96 |
| 396006 | 6.5 | ND | ND | 70 |

As shown above, short antisense compounds having α-L-methyleneoxy (4'-CH$_2$—O-2') BNA modifications led to a dose-dependent reduction in target mRNA levels. Treatment with the short antisense compound having oxyamino BNA modifications led to a modest reduction in target expression.

Example 8

Single Dose Administration Dose Response Study with Short Antisense Compounds Targeting ApoB and PTEN Nucleic Acids Six-week old male Balb/c mice (Jackson Laboratory, Bar Harbor, Me.) were administered a single intraperitoneal (i.p.) injection of antisense compound at a dose of 8, 4, 2 or 1 μmol/kg. Each dose group consisted of four animals. Shown in Table 56 are the sequence, wing chemistry and motif of each antisense compound used in this study. Italicized residues indicate methyleneoxy (4'-CH$_2$—O-2') BNA modifications, underlined residues indicate N-methyl-oxyamino (4'-CH$_2$—N(CH$_3$)—O-2') BNA modifications, and boxed residues indicate α-L-methyleneoxy (4'-CH$_2$—O-2') BNA modifications. All antisense compounds comprise phosphorothioate linkages at each position. Each cytosine of ISIS 116847 and the cytosine residues in the methyleneoxy (4'-CH$_2$—O-2') BNA wings of ISIS 392063 are replaced with 5-methylcytosines, while the thymidine residues in the methyleneoxy (4'-CH$_2$—O-2') BNA wings of ISIS 392745 are replaced with 5-methyl thymidines. PTEN antisense compounds target published PTEN nucleic acid, including Genbank Accession No. U92437.1 (SEQ ID NO: 13). ApoB antisense compounds target published ApoB nucleic acid, including Genbank Accession No. XM_137955.5 (SEQ ID NO: 2).

TABLE 56

Short Antisense Compounds Targeted to ApoB and PTEN Nucleic Acids

| ISIS NO | Target | Target Seq ID | 5' Target Site | SEQUENCE | Gapmer | SEQ ID NO |
|---|---|---|---|---|---|---|
| 387462 | ApoB | 19 | 8235 | GGTACATGGAAGTC | 2-10-2 Methyleneoxy BNA | 193 |
| 392063 | PTEN | 29 | 3099 | CTTAGCACTGGCCT | 2-10-2 Methyleneoxy BNA | 1226 |

TABLE 56-continued

Short Antisense Compounds Targeted to ApoB and PTEN Nucleic Acids

| ISIS NO | Target | Target Seq ID | 5' Target Site | SEQUENCE | Gapmer | SEQ ID NO |
|---|---|---|---|---|---|---|
| 396565 | PTEN | 29 | 3099 | CUTAGCACTGGCCU | 2-10-2 N-Me-oxyamino BNA | 1226 |
| 396006 | PTEN | 29 | 3099 | CUTAGCACTGGCCU | 2-10-2 α-L-methyleneoxy BNA | 1226 |

TABLE 57

% ApoB and PTEN mRNA Reduction (relative to saline control)

| ISIS NO | Dose (μmol/kg) | % ApoB mRNA Reduction (relative to saline) | % PTEN mRNA Reduction (relative to saline) |
|---|---|---|---|
| 387462 | 8 | 0.62 | 92.8 |
|  | 4 | 6.55 | 103 |
|  | 2 | 18.6 | 105 |
|  | 1 | 42.0 | 98.0 |
| 392063 | 8 | 126 | 6.79 |
|  | 4 | 111 | 18.1 |
|  | 2 | 112 | 42.4 |
|  | 1 | 114 | 62.3 |
| 396565 | 8 | 116 | 23.8 |
|  | 4 | 1.04 | 46.6 |
|  | 2 | 94.4 | 76.1 |
|  | 1 | 115 | 89.5 |
| 396006 | 8 | 94.3 | 62.9 |
|  | 4 | 101 | 18.2 |
|  | 2 | 79.7 | 52.4 |
|  | 1 | 111 | 82.4 |

As shown in Table 57, each short antisense compound having Methyleneoxy BNA modifications demonstrated a dose-dependent reduction in target mRNA levels. Notably, the short antisense compound with N-methyl-oxyamino BNA wings (ISIS 396565) also demonstrated dose-dependent reduction in PTEN expression similar to both the β-D-methyleneoxy BNA and α-L-methyleneoxy BNA short antisense compounds. Next, estimated $ED_{50}$ concentrations for each antisense were calculated using Graphpad Prism. The results are shown below in Table 58.

TABLE 58

Estimated $ED_{50}$ Concentrations

| Wing Chemistry | ISIS NO | $ED_{50}$ (μmole/kg) | $ED_{50}$ (mg/kg) |
|---|---|---|---|
| Methyleneoxy BNA | 387462 | 0.8 | 3.9 |
| Methyleneoxy BNA | 392063 | 1.5 | 7 |
| N-Me-oxyamino BNA | 396565 | 3.8 | 17.4 |
| α-L-methyleneoxy BNA | 396006 | 2.1 | 9.3 |

Example 9

Administration of a Parent and Parent Mixed Backbone Antisense Compound Targeting SGLT-2 mRNA ISIS 257016 was administered to db/db mice (Charles River Laboratories, Wilmington, Mass.) intraperitoneally at a dose of 1, 7.5, 14 or 17 mg/kg twice a week. Control groups included a group receiving saline on the same dosing schedule and a group receiving ISIS 145733. ISIS 257016 and ISIS 145733 both comprise the sequence GAAGTAGCCAC-CAACTGTGC (SEQ ID NO: 1572) further comprising a central "gap" region consisting of ten 2'-deoxynucleotides, which is flanked on both sides (5' and 3' directions) by five-nucleotide "wings". The wings are composed of 2'-methoxy-ethyl (2'-MOE) nucleotides. All cytidine residues are 5-methylcytidines. The internucleoside (backbone) linkages are phosphorothioate (P=S) throughout the oligonucleotide for ISIS 145733; however ISIS 257016 has a mixed backbone. The internucleoside linkages for ISIS 257016 are phosphodiester (P=O) in the wings and phosphorothioate in the gap. Forty-eight hours following administration of the last dose the mice were sacrificed and kidney tissue was analyzed for SGLT-2 mRNA levels. The results are shown below in Table 59.

TABLE 59

Antisense inhibition of SGLT2 mRNA expression in vivo by 5-10-5 MOE gapmers

| Dose of oligonucleotide | % change in SGLT2 expression relative to saline | |
|---|---|---|
| nmol/kg | ISIS 145733 | ISIS 257016 |
| 17 | −37.5 | −76 |
| 14 | −31.25 | −74 |
| 7.5 | −12.5 | −62.5 |
| 1 | +3 | −44 |

Both ISIS 257016 and ISIS 145733 markedly reduced SGLT-2 levels compared to saline control. (mRNA levels determined using RT, real-time PCR as described above) However, ISIS 257016 has been shown to be about 20-50 times more potent for reducing SGLT-2 mRNA compared to ISIS 145733. An associated reduction in plasma glucose levels was seen for the treatment groups (661±14 for the saline group compared to 470±23 for the group receiving ISIS 257016). Accumulation of ISIS 257016 and ISIS 145733 in the kidney was similar over the dose range, however little of the full length 257016 antisense was detected in the kidney which supports the theory that a degradation product is responsible for the increased activity. Also the onset of action following a single dose of 25 mg/kg correlated to a time pint were little intact 257016 antisense compound was left.

Similar studies were performed in lean mice, ob/ob mice and in ZDF rats (Charles Rivers Laboratories) using ISIS 257016, ISIS 145733 or saline in a similar same dosing schedule as described above. The sequence of the binding site for ISIS 145733 and ISIS 257016 is conserved between mouse and rat (see Table 60). Reduction of SGLT-2 mRNA in the kidney was similar to that seen above. In a study utilizing rats, at a dose of 10 mg/kg given two times a week for two weeks, ISIS 145733 was shown to reduce SGLT-2 mRNA levels by about 40% whereas the reduction achieved with ISIS 257016 was greater than 80%. ISIS 257016 reduces SGLT2 expression maximally at a low dose of 12.5 mg/kg. Additional studies at lower dosing ranges show significant reduction of SGLT2 mRNA levels with the mixed backbone antisense compound at doses less than 1 mg/kg/wk.

Example 10

Administration of a Parent and Short Antisense Compound Targeting SGLT-2 mRNA

Pharmacokinetic studies indicated that ISIS 257016 was acting as a prodrug that was metabolized to a 12 nucleobase pharmacophore. In a next study, ZDF rats were dosed intraperitoneally twice per week with 1.5 mg/kg of either ISIS 257016 or ISIS 370717, or with saline at a similar dosing schedule. ISIS 370717 is a 12 nucleobase antisense compound targeted to SGLT-2 nucleic acid comprising the sequence TAGCCACCAACT (SEQ ID NO: 154) and further comprising central "gap" region consisting of ten 2'-deoxynucleotides, which is flanked on both sides (5' and 3' directions) by one-nucleotide "wings". The wings are composed of 2'-methoxyethyl (2'-MOE) nucleotides. All cytidine residues are 5-methylcytidines. The internucleoside (backbone) linkages are phosphorothioate (P=S) throughout the oligonucleotide.

Following five weeks of dosing the animals were sacrificed and kidney tissue was analyzed for SGLT-2 mRNA levels. The pharmacological activity of ISIS 257016 and ISIS 370717 were similar, however, the 12 nucleotide antisense compound displayed a faster onset of action. ISIS 370717 displayed nearly 80% inhibition of SGLT2 expression in kidney on day two after a single dose of 2.8 umoles/kg whereas ISIS 257016 displayed only about 25% inhibition on day 2 after the same single dose administration. The date support that ISIS 257016 is a prodrug having a 12 nucleotide pharmacophore.

Example 11

Potency and Bioavailability of a Short Antisense Compound

The improved potency displayed by ISIS 370717 and the improved oral bioavailability for these short antisense compounds makes these compounds useful for oral administration. Normal rats received ISIS 370717, ISIS 145733 or saline at 100 mg/kg twice per week via intrajejunal administration. About 48 hours following the last dose, the animals were sacrificed and kidney tissue was analyzed for antisense compound concentration and SGLT-2 mRNA levels. There was a significantly higher accumulation of ISIS 370717 in the kidney tissue (approximately 500 micro grams per gram of tissue) compared to the controls. Moreover, SGLT-2 mRNA was reduced by more than 80% over the controls.

Example 12

Wing, Gap and Total Length Variations Around a 12 Nucleotide Short Antisense Compound ISIS 370717 1-10-1 MOE gapmer was used as a template to make sequence related oligos with varying motifs. These variations are provided in Table 60. The antisense compounds were designed to target different regions of the mouse or rat SGLT2 nucleic acid, using published sequences (GenBank accession number U29881.1, incorporated herein as SEQ ID NO: 1575, and GenBank accession number AJ292928.1, incorporated herein as SEQ ID NO: 1576, respectively).

TABLE 60

Short Antisense compounds targeting SGLT2 nucleic acids

| ISIS NO | 5' Target Site on mouse SEQ ID NO: 1576 | 5' Target Site on rat SEQ ID NO: 1575 | Gapmer Motif | Sequence (5'-3') | SEQ ID NO |
|---|---|---|---|---|---|
| 257016 | 2680 | 148 | 5-10-5 MOE | <u>GAAGT</u>AGCCACCAAC<u>TGTGC</u> | 1553 |
| 370717 | 2684 | 152 | 1-10-1 MOE | <u>T</u>AGCCACCAAC<u>T</u> | 1554 |
| 386169 | 2684 | 152 | 2-8-2 MOE | <u>TA</u>GCCACCAA<u>CT</u> | 1555 |
| 386176 | 2685 | 153 | 1-8-1 MOE | <u>A</u>GCCACCAA<u>C</u> | 1556 |
| 386196 | 2684 | 152 | 3-6-3 MOE | <u>TAG</u>CCACCA<u>ACT</u> | 1557 |

The antisense compounds were analyzed for their effect on mouse SGLT2 mRNA levels. Data are ranges taken from three experiments in which mice were dosed twice per week for three weeks with 2.5, 0.5 or 0.1 umol/kg of the above MOE gapmers given by intraperitoneal injection. Mice were sacrificed 48 hours following last administration and evaluated for SGLT2 levels in kidney. SGLT2 mRNA levels were determined by RT, real-time PCR as described by other examples herein. PCR results were normalized to an internal ISIS control. The results are shown below in Table 61.

TABLE 61

Antisense inhibition of SGLT2 in vivo by 1-10-1 and 1-10-2 MOE gapmers

| Dose of oligonucleotide umol/kg | ISIS 370717 | ISIS 386169 | ISIS 386176 | ISIS 386196 | ISIS 386197 |
|---|---|---|---|---|---|
| | % change in SGLT2 expression relative to saline | | | | |
| 2.5 | −82 | −85 | −80 | −50 | −20 |
| 0.5 | −70 | −80 | −68 | −30 | −15 |
| 0.1 | −55 | −70 | −65 | −35 | −20 |

These results illustrate that all the various motifs tested inhibit the expression of SGLT2 in vivo in a dose-dependent manner. The 1-10-1, 2-8-2 and 1-8-1 gapmers were found to be particularly potent.

Example 13

Antisense Inhibition of Rat SGLT-2 by 1-10-1 and 1-10-2 MOE Gapmers 1-10-1 and 1-10-2 MOE gapmer antisense compounds, provided in Table 62, were designed to target different regions of the mouse or rat SGLT2 RNA. All short antisense compounds in Table 62 are chimeric oligonucleotides ("gapmers") either 12 or 13 nucleotides in length, composed of a central "gap" segment consisting of ten 2'-deoxynucleotides, which are flanked on the 5' side by a one-nucleoside "wing" and on the 3' side by a two or one-nucleotide "wing". The wings are composed of 2'-methoxyethyl (2'-MOE) nucleotides. The internucleoside (backbone) linkages are phosphorothioate (P=S) throughout the oligonucleotide. All cytidine residues are 5-methylcytidines.

TABLE 62

Antisense compounds targeting SGLT2 nucleic acid

| ISIS NO | 5' Target Site on SEQ ID NO: 1576 (mouse) | 5' Target Site on SEQ ID NO: 1575 (rat) | Gapmer Motif | Sequence (5'-3') | SEQ ID NO |
|---|---|---|---|---|---|
| 370717 | 2684 | 152 | 1-10-1 | MOETAGCCACCAACT | 1554 |
| 382675 | 2683 | 151 | 1-10-1 | MOETAGCCACCAACTG | 1559 |
| 379692 | | 508 | 1-10-1 | MOETGTTCCAGCCCA | 246 |
| 382676 | | 507 | 1-10-2 | MOETGTTCCAGCCCAG | 246 |
| 379699 | | 1112 | 1-10-2 | MOEGGCATGAGCTTC | 281 |
| 382677 | | 1111 | 1-10-2 | MOEGGCATGAGCTTCA | 281 |
| 382677 | | 958 | 1-10-2 | MOEGGCATGAGCTTCA | 281 |

The short antisense compounds were analyzed for their effect on rat SGLT2 mRNA levels. Data are ranges taken from three experiments in which Male Sprague-Dawley rats (170-200 g) were dosed twice per week for three weeks with 450, 150 or 50 nmol/kg of either a 1-10-1 or 1-10-2 MOE gapmer given by intraperitoneal injection. Rats were sacrificed 48 hours following last administration and evaluated for SGLT2 mRNA levels in kidney. Target levels were determined by RT, real-time PCR as described by other examples herein. PCR results were normalized to an internal ISIS control. The results are shown below in Table 63.

TABLE 63

Antisense inhibition of SGLT2 mRNA in vivo by 1-10-1 and 1-10-2 MOE gapmers

| Dose of oligonucleotide nmol/kg | ISIS 370717 1-10-1 | ISIS 382675 1-10-2 | ISIS 379692 1-10-1 | ISIS 382676 1-10-2 | ISIS 379699 1-10-1 | ISIS 382677 1-10-2 |
|---|---|---|---|---|---|---|
| | % change in SGLT2 expression relative to saline | | | | | |
| 450 | −70 | −80 | −90 | −85 | −83 | −75 |
| 150 | −70 | −65 | −85 | −80 | −75 | −60 |
| 50 | −55 | −50 | −80 | −65 | −60 | −40 |

These results illustrate that both the 1-10-1 and 1-10-2 MOE gapmers reduce SGLT2 mRNA in vivo in a dose-dependent manner.

Rats were further evaluated for total body weight, liver, spleen and kidney weight. Significant changes in spleen, liver or body weight can indicate that a particular compound causes toxic effects. All changes were within the margin of error of the experiment. No significant changes in body weight were observed during the treatment or at study termination. No significant changes in liver or spleen weights were observed.

Toxic effects of short antisense compounds administered in vivo can also be assessed by measuring the levels of enzymes and proteins associated with disease or injury of the liver or kidney. Elevations in the levels of the serum transaminases aspartate aminotransferase (AST) and alanine aminotransferase (ALT) are often indicators of liver disease or injury. Serum total bilirubin is an indicator of liver and biliary function, and albumin and blood urea nitrogen (BUN) are indicators of renal function. Glucose and triglyceride levels are sometimes altered due to toxicity of a treatment. Serum glucose also depends in part upon the activity of SGLT2. The levels of ALT, AST, total bilirubin, albumin, BUN, glucose and triglyceride were measured in rats treated with the short antisense compounds. The levels of routine clinical indicators of liver and kidney injury and disease were within normal ranges and are not significantly changed relative to saline-treated animals, demonstrating that the short antisense compounds do not significantly affect renal or hepatic function. Triglyceride and glucose levels were not significantly elevated relative to saline-treated animals.

Example 14

Antisense Inhibition of Mouse and Rat SGLT2 by 1-10-1 MOE Gapmers 1-10-1 MOE gapmer antisense compounds designed to target different regions of mouse SGLT2 mRNA are shown in Table 64.

TABLE 64

Composition of Antisense Compounds Targeting SGLT2 mRNA

| ISIS NO | 5' Target Site on SEQ ID NO: 1576 (mouse) | 5' Target Site on SEQ ID NO: 1575 (rat) | Motif | Sequence (5'-3') | SEQ ID NO |
|---|---|---|---|---|---|
| 370717 | 2684 | 152 | 1-10-1 | MOE<u>T</u>AGCCACCAAC<u>T</u> | 1554 |
| 379692 |  | 508 | 1-10-1 | MOE<u>T</u>GTTCCAGCCC<u>A</u> | 246 |
| 379699 |  | 1112 | 1-10-1 | MOE<u>GG</u>CATGAGCTT<u>C</u> | 281 |
| 379702 |  | 1525 | 1-10-1 | MOE<u>G</u>CACACAGCTG<u>C</u> | 293 |
| 381408 | 3034** |  | 1-10-1 | MOE<u>T</u>ACCGAACACC<u>T</u> | 1560 |

**indicates 3 mismatches to a target sequence

The short antisense compounds were analyzed for their effect on mouse SGLT2 mRNA levels. Data was taken from three experiments in which Male 6-week old Balb/c mice were dosed twice per week for two weeks with 450, 150, or 50 nmol/kg of one of the above 1-10-1 MOE gapmers given by intraperitoneal injection. Mice were sacrificed 48 hours following last administration and evaluated for SGLT2 mRNA levels in kidney. Target levels were determined by RT, real-time PCR as described by other examples herein. PCR results were normalized to an internal ISIS control. The results are shown below in Table 65.

TABLE 65

Antisense inhibition of SGLT2 mRNA in vivo by 1-10-1 MOE gapmers

| | % change in SGLT2 expression relative to saline | | | | |
|---|---|---|---|---|---|
| Dose of oligonucleotide nmol/kg | ISIS 370717 | ISIS 379692 | ISIS 379699 | ISIS 379702 | ISIS 381408 |
| 450 | −65 | −80 | −80 | −75 | — |
| 150 | −55 | −70 | −62.5 | −72.5 | — |
| 50 | −47.5 | −52.5 | −42.5 | −52.5 | — |

These results illustrate that all the 1-10-1 MOE gapmers except, ISIS 381408, inhibit the expression of SGLT2 in vivo in a dose-dependent manner in mouse. Activity of ISIS 381408 has been shown in Rat studies (See Table 65).

Evaluation of 1-10-1 Gapmers in Rat

The effect of the above 1-10-1 gapmers (see Table 64 above) on rat SGLT2 mRNA levels. Data are taken from four experiments in which male Sprague-Dawley rats (170-200 g) were dosed twice per week for three weeks with 250 nmol/kg given by intraperitoneal injection. Rats were sacrificed 48 hours following last administration and evaluated for SGLT2 mRNA levels in kidney. Target levels were determined by RT, real-time PCR as described by other examples herein. PCR results were normalized to an internal ISIS control. The results are shown below in Table 66.

TABLE 66

Antisense inhibition of SGLT2 mRNA in vivo by 1-10-1 MOE gapmers

| | % change in SGLT2 expression relative to saline | | | | |
|---|---|---|---|---|---|
| Dose of oligonucleotide nmol/kg | ISIS 370717 | ISIS 379692 | ISIS 379699 | ISIS 379702 | ISIS 381408 |
| 250 | −70 | −85 | −75 | −25 | −5 |

These results illustrate that all the 1-10-1 MOE gapmers inhibit the expression of SGLT2 in in vivo rat studies.

Example 15

Antisense Inhibition of Mouse and Rat SGLT2 Expression by Additional 1-10-1 and 2-8-2 MOE Gapmers 1-10-1 and 2-8-2 MOE gapmer short antisense compounds were designed to target different regions of the mouse SGLT2 RNA but have complementarity across species. The short antisense compounds are shown in Table 67. All short antisense compounds in Table 67 are gapmers 12 nucleotides in length, composed of a central "gap" segment consisting of 2'-deoxynucleotides, which are flanked on both sides (5' and 3' directions) by wing segments having 2'-modifications. The wings are composed of 2'-methoxyethyl (2'-MOE) nucleotides. The internucleoside (backbone) linkages are phosphorothioate (P=S) throughout the oligonucleotide. All cytidine residues are 5-methylcytidines.

TABLE 67

Short Antisense Compounds Targeting SGLT2 nucleic acid

| ISIS NO | 5' Target Site (rat) | Target SEQ ID (rat) | Gapmer Motif | Sequence (5'-3') | SEQ ID NO |
|---|---|---|---|---|---|
| 379692 | 508 | 1575 | 1-10-1 MOE | TGTTCCAGCCCA | 246 |
| 388625 | 508 | 1575 | 1-10-1 MOE | TGTTCCAGCCCA | 246 |
| 379699 | 1112 | 1575 | 1-10-1 MOE | GGCATGAGCTTC | 281 |
| 388626 | 1112 | 1575 | 2-8-2 MOE | GGCATGAGCTTC | 281 |
| 379702 | 1525 | 1575 | 2-8-2 MOE | GCACACAGCTGC | 293 |
| 388627 | 1525 | 1575 | 2-8-2 MOE | GCACACAGCTGC | 293 |

The short antisense compounds were analyzed for their effect on mouse SGLT2 mRNA levels in vivo. Data was taken from three experiments in which male 6-week old Balb/c mice were dosed twice per week for three weeks with 0.5, 0.1, or 0.02 umol/kg of either a 1-10-1 or 2-8-2 MOE gapmer given by intraperitoneal injection. Mice were sacrificed 48 hours following last administration and evaluated for SGLT2 levels in kidney. Target levels were determined by RT, real-time PCR as described by other examples herein. PCR results were normalized to an internal ISIS control. The results are shown below in Table 68.

TABLE 68

Antisense inhibition of SGLT2 mRNA in vivo by 1-10-1 and 2-8-2 MOE gapmers

| Dose of oligonucleotide umol/kg | % change in SGLT2 expression relative to saline | | | | | |
|---|---|---|---|---|---|---|
| | ISIS 379692 1-10-1 | ISIS 388625 2-8-2 | ISIS 379699 1-10-1 | ISIS 388626 2-8-2 | ISIS 379702 1-10-1 | ISIS 388627 2-8-2 |
| 0.5 | −85 | −90 | −75 | −80 | −70 | −65 |
| 0.1 | −75 | −88 | −60 | −60 | −65 | −50 |
| 0.02 | −55 | −65 | −30 | −45 | −40 | −38 |

These results illustrate that both the 1-10-1 and 2-8-2 MOE gapmers inhibit the expression of SGLT2 in vivo in a dose-dependent manner.

Mice were further evaluated for total body weight, liver, spleen and kidney weight. All changes were within the margin of error of the experiment. No significant changes in body weight were observed during the treatment or at study termination. No significant changes in liver or spleen weights were observed.

The levels of ALT, AST, BUN, transaminases, plasma creatinine, glucose and triglyceride were measured in mice treated with the short antisense compounds. The levels of routine clinical indicators of liver and kidney injury and disease were within normal ranges and are not significantly changed relative to saline-treated animals, demonstrating that the short antisense compounds do not significantly affect renal or hepatic function. Triglyceride and glucose levels were not significantly elevated relative to saline-treated animals.

Evaluation of ISIS 379692 1-10-1 MOE Gapmer, ISIS 392170 1-10-1 Methyleneoxy BNA Gapmer, ISIS 388625 2-8-2 MOE Gapmer and ISIS 392173 2-8-2 Methyleneoxy BNA Gapmer in Mice The effect of ISIS 379692 1-10-1 MOE gapmer and ISIS 388625 2-8-2 MOE gapmer are compared with the effect of ISIS 392170 1-10-1 Methyleneoxy BNA Gapmer and ISIS 392173 2-8-2 Methyleneoxy BNA Gapmer (see Table 69) on mouse SGLT2 mRNA levels in vivo. Data are taken from three experiments in which male 6-week old Balb/c mice were dosed twice per week for three weeks with 5, 25 and 125 nmol/kg of either the ISIS 379692 1-10-1 MOE gapmer or the ISIS 388625 2-8-2 MOE gapmer given by intraperitoneal injection. Mice were sacrificed 48 hours following last administration and evaluated for SGLT2 mRNA levels in kidney. Target levels were determined by RT, real-time PCR as described by other examples herein. PCR results were normalized to an internal ISIS control. The data are expressed as percent change ("+" indicates an increase, "−" indicates a decrease) relative to saline treated animals and are illustrated in Table 69.

TABLE 69

Antisense inhibition of SGLT2 mRNA in vivo by a 1-10-1 and a 2-8-2 MOE gapmer

| Dose of oligonucleotide nmol/kg | ISIS 379692 1-10-1 MOE | ISIS 392170 1-10-1 Methyleneoxy BNA | ISIS 388625 2-8-2 MOE | ISIS 392173 2-8-2 Methyleneoxy BNA |
|---|---|---|---|---|
| 125 | −58 | −69 | −70 | −75 |
| 25 | −46 | −54 | −47 | −57 |
| 5 | −7 | −23 | −18 | −44 |

These results illustrate that both the 1-10-1 and 2-8-2 MOE gapmer inhibit the expression of SGLT2 in vivo at the highest three dosing ranges in a dose-dependent manner. The results also illustrate that the Methyleneoxy BNA constructs are more potent then the MOE constructs. No significant changes in body weight were observed during the treatment or at study termination. No significant changes in liver or spleen weights were observed. The toxicity parameters including levels of ALT, AST, BUN, and creatinine were within normal ranges and are not significantly changed relative to saline-treated animals, demonstrating that the compounds do not significantly affect renal or hepatic function.

Evaluation of ISIS 379692 1-10-1 MOE Gapmer and ISIS 388625 2-8-2 MOE Gapmer in Rat The effect of ISIS 379692 1-10-1 MOE gapmer and ISIS 388625 MOE 2-8-2 gapmer (see Table 70) on rat SGLT2 mRNA levels in vivo. Data are taken from four experiments in which male Sprague-Dawley rats (170-200 g) were dosed twice per week for three weeks with 200, 50, 12.5, or 3.125 nmol/kg of either the ISIS 379692 1-10-1 MOE gapmer or the ISIS 388625 2-8-2 MOE gapmer given by intraperitoneal injection. Rats were sacrificed 48 hours following last administration and evaluated for SGLT2 levels in kidney. Target levels were determined by RT, real-time PCR as described by other examples herein. PCR results were normalized to an internal ISIS control. The results are shown below in Table 70.

TABLE 70

Antisense inhibition of SGLT2 mRNA in vivo by a 1-10-1 and a 2-8-2 MOE gapmer

| Dose of oligonucleotide umol/kg | % change in SGLT2 expression relative to saline | |
|---|---|---|
| | ISIS 379692 1-10-1 | ISIS 388625 2-8-2 |
| 200 | −80 | −80 |
| 50 | −65 | −65 |
| 12.5 | −15 | −15 |
| 3.125 | +30 | +25 |

These results illustrate that both the 1-10-1 and 2-8-2 MOE gapmer inhibit the expression of SGLT2 in vivo at the highest three dosing ranges in a dose-dependent manner.

Rats were further evaluated for total body weight, liver, spleen and kidney weight. All changes were within the margin of error of the experiment. No significant changes in body weight were observed during the treatment or at study termination. No significant changes in liver or spleen weights were observed.

The levels of ALT, AST, BUN, cholesterol, plasma creatinine and triglycerides were measured in rats treated with the short antisense compounds. The levels of routine clinical indicators of liver and kidney injury and disease were within normal ranges and are not significantly changed relative to saline-treated animals, demonstrating that the short antisense compounds do not significantly affect renal or hepatic function.

Example 16

Antisense Inhibition of SGLT2 Expression in ZDF Rat

ISIS 388625, 388626 and control oligo ISIS 388628 were analyzed for their effect on ZDF rat plasma glucose levels and HbA1c. The leptin receptor deficient Zucker diabetic fatty (ZDF) rat is a useful model for the investigation of type 2 diabetes. Diabetes develops spontaneously in these male rats at ages 8-10 weeks, and is associated with hyperphagia, polyuria, polydipsia, and impaired weight gain, symptoms which parallel the clinical symptoms of diabetes (Phillips M S, et al., 1996, Nat Genet 13, 18-19). Six week old ZDF rats were injected intraperitoneally with short antisense compound at a dose of 400 nM/kg once a week for twelve weeks. Data are illustrated in Tables 71 and 72.

TABLE 71

Plasma glucose

| ISIS NO. | Seq ID NO | Sequence (5'-3') | Motif | Plasma glucose levels recorded on specific dates (mg/dl) | | | |
|---|---|---|---|---|---|---|---|
| | | | | Day 10 | Day 40 | Day 55 | Day 66 |
| PBS | | n/a | n/a | 450.7 | 478.5 | 392.8 | 526.2 |
| 388625 | 246 | TGTTCCAGCCCA | 2-8-2 MOE | 435.5 | 278.7 | 213.8 | 325.5 |
| 388626 | 281 | GGCATGAGCTTC | 2-8-2 MOE | 434.7 | 300.5 | 219.8 | 379.8 |
| 388628 | 226 | TAGCCGCCCACA | 2-8-2 MOE | 436.0 | 502.0 | 411.2 | 668.8 |

TABLE 72

HbA1c Status

| ISIS NO. | Seq ID NO | Sequence (5'-3') | Motif | Percentage HbA1c on specific dates (%) $p < 0.001$ | | |
|---|---|---|---|---|---|---|
| | | | | Day 40 | Day 55 | Day 68 |
| PBS | | n/a | n/a | 8.0 | 8.9 | 10.0 |
| 388625 | 246 | TGTTCCAGCCCA | 2-8-2 MOE | 6.5 | 5.8 | 4.3 |
| 388626 | 281 | GGCATGAGCTTC | 2-8-2 MOE | 6.6 | 5.9 | 4.0 |
| 388628 | 226 | TAGCCGCCCACA | 2-8-2 MOE | 8.0 | 9.1 | 7.8 |

ISIS 388625 and 388626 significantly reduced plasma glucose levels and HbA1C compared to PBS and control treated animals.

Example 17

Antisense Inhibition of SGLT2 Expression in Dog Kidney (ISIS 388625)

ISIS 388625 is a 2-8-2 MOE Gapmer with sequence TGTTCCAGCCCA (SEQ ID NO: 246) (e.g. see Table 71). The effect of ISIS 388625 on dog SGLT2 mRNA levels. Data are taken from two dosing groups in which a total of nine male beagle dogs were dosed with either one or ten mg/kg/week of ISIS or saline given by subcutaneous injection twice weekly. On day 46 of the study all dogs were sacrificed and evaluated for SGLT2 levels in kidney. Target levels were determined by quantitative RT, real-time PCR as described by other examples herein. PCR results were normalized to an internal ISIS control. The results are shown below in Table 73.

TABLE 73

Antisense inhibition of SGLT2 mRNA in vivo by ISIS 388625

| Dose of oligonucleotide mg/kg/wk | % change in SGLT2 expression Relative to saline ISIS 388625 |
|---|---|
| 1 | −85 |
| 10 | −95 |

These results illustrate that greater than 80% reduction of SGLT2 mRNA can be achieved at a 1 mg/kg/wk dose of ISIS 388625. Even greater reduction can be achieved at slightly higher doses. Administration of ISIS 388625 in dog was also shown to improve glucose tolerance. Peak plasma glucose levels were decreased by over 50% on average and the subsequent drop in glucose was lessened compared to saline controls in a standard glucose tolerance test. Urinary glucose excretion was also increased.

Example 18

In Vivo Testing of Short Antisense Compounds Targeted to SGLT2 Nucleic Acid

Twenty 1-10-1 MOE gapmers that are complementary to human/monkey/mouse/rat SGLT2 were designed, synthesized and tested in vivo for suppression of SGLT2 mRNA levels in kidney. Target sites for mouse and rat are indicated in Table 74. Target sites for human are indicated in Tables 4 and 5. Data are averages from two experiments in which male 6-week old Balb/c mice were administered intraperitoneal injections of 350 nmol/kg of oligonucleotide, twice per week, over a period of two weeks (a total of four injections). Mice were sacrificed 48 hours following the last administration and evaluated for SGLT2 mRNA levels in kidney. SGLT2 mRNA levels were determined by quantitative real-time PCR analysis according to standard procedures, using two different PCR primer probe sets, primer probe set (PPS) 534 and PPS 553. SGLT2 mRNA levels were normalized to cyclophilin mRNA levels, which were also measured by quantitative real-time PCR. The results are shown below in Table 74.

TABLE 74

Antisense inhibition of SGLT2 in vivo

| ISIS NO | 5' Target Site on SEQ ID NO: 1576 (mouse) | 5' Target Site on SEQ ID NO: 1575 (rat) | Sequence (5'-3') | Motif | PPS 534% Saline | PPS 553% Saline | SEQ ID NO |
|---|---|---|---|---|---|---|---|
| PBS | | | N/A | | − | − | |
| 370717 | 2684 | 152 | TAGCCACCAACT | 1-10-1 MOE | −84.4 | −84.3 | 1554 |
| 379684 | 2070 | 64 | TGTCAGCAGGAT | 1-10-1 MOE | −45.0 | −43.2 | 214 |
| 379685 | 2103 | 97 | TGACCAGCAGGA | 1-10-1 MOE | −10.3 | −20.5 | 219 |
| 379686 | 2121* | 115 | ACCACAAGCCAA | 1-10-1 MOE | −71.9 | −75.1 | 225 |
| 379687 | 2824 | 216 | GATGTTGCTGGC | 1-10-1 MOE | −47.1 | −52.1 | 230 |
| 379688 | 2876 | 268 | CCAAGCCACTTG | 1-10-1 MOE | −62.6 | −70.4 | 240 |
| 379689 | | 298 | AGAGCGCATTCC | 1-10-1 MOE | −17.5 | −30.4 | 241 |
| 379690 | | 415 | ACAGGTAGAGGC | 1-10-1 MOE | −18.9 | −22.5 | 242 |
| 379691 | | 454 | AGATCTTGGTGA | 1-10-1 MOE | −35.0 | −48.6 | 243 |
| 379692 | | 508 | TGTTCCAGCCCA | 1-10-1 MOE | −88.1 | −88.5 | 246 |

TABLE 74-continued

Antisense inhibition of SGLT2 in vivo

| ISIS NO | 5' Target Site on SEQ ID NO: 1576 (mouse) | 5' Target Site on SEQ ID NO: 1575 (rat) | Sequence (5'-3') | Motif | PPS 534% Saline | PPS 553% Saline | SEQ ID NO |
|---|---|---|---|---|---|---|---|
| 379693 | | 546 | CATGGTGATGCC | 1-10-1 MOE | -51.6 | -59.9 | 254 |
| 379694 | | 609 | GACGAAGGTCTG | 1-10-1 MOE | -42.1 | -54.4 | 264 |
| 379695 | | 717 | GGACACCGTCAG | 1-10-1 MOE | -52.5 | -64.1 | 266 |
| 379696 | | 954 | CAGCTTCAGGTA | 1-10-1 MOE | -24.6 | -36.2 | 267 |
| 379697 | | 982 | CTGGCATGACCA | 1-10-1 MOE | -32.0 | -46.3 | 272 |
| 379698 | | 1071 | GCAGCCCACCTC | 1-10-1 MOE | -11.8 | -27.0 | 275 |
| 379699 | | 1112 | GGCATGAGCTTC | 1-10-1 MOE | -83.5 | -85.8 | 281 |
| 379700 | | 1138 | CCAGCATGAGTC | 1-10-1 MOE | -2.8 | -16.4 | 285 |
| 379701 | | 1210 | CCATGGTGAAGA | 1-10-1 MOE | -0.3 | -11.9 | 288 |
| 379702 | | 1525 | GCACACAGCTGC | 1-10-1 MOE | -87.8 | -89.5 | 293 |
| 379703 | | 1681 | GCCGGAGACTGA | 1-10-1 MOE | -44.2 | -45.9 | 295 |

*indicates 1 or 2 mismatches to a target sequence

Example 19

Antisense Inhibition of Human PCSK9 in Hep3B Cells

Short antisense compounds targeted to a PCSK9 nucleic acid were tested for their effects on PCSK9 mRNA in vitro. The short antisense compounds are presented in Table 6. The Isis No, gapmer motif and SEQ ID NO of each short antisense compound are shown again in Table 75. Cultured Hep3B cells were treated with 100 nM of short antisense compound. 5-10-5 MOE gapmers targeted to a PCSK9 nucleic acid were used as positive controls. After the treatment period, RNA was isolated from the cells and PCSK9 mRNA levels were measured by quantitative real-time PCR, as described herein. PCSK9 mRNA levels were adjusted according to total RNA content as measured by RIBOGREEN®. Results are presented in Table 75 as percent inhibition of PCSK9 (% Inhib), relative to untreated control cells. In the "% Inhib" column, a "0" indicates that no reduction of PCSK9 mRNA was observed with that particular short antisense compound.

TABLE 75

Antisense inhibition of PCSK9 by short antisense compounds

| ISIS No. | SEQ ID NO | 5' Target Site on SEQ ID NO: 4 | 3' Target Site on SEQ ID NO: 4 | Gapmer Motif | % Inhibition Range | % Inhib |
|---|---|---|---|---|---|---|
| 400297 | 329 | 695 | 708 | 2-10-2 MOE | | 0 |
| 400298 | 330 | 696 | 709 | 2-10-2 MOE | | 0 |
| 400299 | 331 | 697 | 710 | 2-10-2 MOE | | 0 |
| 400300 | 332 | 742 | 755 | 2-10-2 MOE | | 9 |
| 400301 | 333 | 757 | 770 | 2-10-2 MOE | 20-30% | 27 |
| 400302 | 334 | 828 | 841 | 2-10-2 MOE | | 0 |
| 400303 | 335 | 829 | 842 | 2-10-2 MOE | | 0 |
| 400304 | 336 | 830 | 843 | 2-10-2 MOE | 10-20% | 11 |
| 400305 | 337 | 937 | 950 | 2-10-2 MOE | 30-40% | 38 |
| 400306 | 338 | 952 | 965 | 2-10-2 MOE | 40-50% | 40 |
| 400307 | 339 | 988 | 1001 | 2-10-2 MOE | 70-80% | 76 |
| 400308 | 340 | 989 | 1002 | 2-10-2 MOE | 50-60% | 55 |
| 400309 | 341 | 990 | 1003 | 2-10-2 MOE | 40-50% | 44 |
| 400310 | 342 | 991 | 1004 | 2-10-2 MOE | | 8 |
| 400311 | 343 | 992 | 1005 | 2-10-2 MOE | 10-20% | 18 |
| 400312 | 344 | 993 | 1006 | 2-10-2 MOE | 20-30% | 28 |
| 400313 | 345 | 994 | 1007 | 2-10-2 MOE | 10-20% | 10 |
| 400314 | 346 | 1057 | 1070 | 2-10-2 MOE | 20-30% | 26 |
| 400315 | 347 | 1075 | 1088 | 2-10-2 MOE | | 0 |
| 400316 | 348 | 1076 | 1089 | 2-10-2 MOE | | 8 |
| 400317 | 349 | 1077 | 1090 | 2-10-2 MOE | | 7 |
| 400318 | 350 | 1078 | 1091 | 2-10-2 MOE | 20-30% | 26 |
| 400319 | 351 | 1093 | 1106 | 2-10-2 MOE | | 0 |
| 400320 | 352 | 1094 | 1107 | 2-10-2 MOE | | 0 |

TABLE 75-continued

Antisense inhibition of PCSK9 by short antisense compounds

| ISIS No. | SEQ ID NO | 5' Target Site on SEQ ID NO: 4 | 3' Target Site on SEQ ID NO: 4 | Gapmer Motif | % Inhibition Range | % Inhib |
|---|---|---|---|---|---|---|
| 400321 | 353 | 1095 | 1108 | 2-10-2 MOE | | 0 |
| 400322 | 354 | 1096 | 1109 | 2-10-2 MOE | | 0 |
| 400323 | 355 | 1147 | 1160 | 2-10-2 MOE | | 0 |
| 400324 | 356 | 1255 | 1268 | 2-10-2 MOE | | 7 |
| 400325 | 357 | 1334 | 1347 | 2-10-2 MOE | | 4 |
| 400326 | 358 | 1335 | 1348 | 2-10-2 MOE | | 0 |
| 400327 | 359 | 1336 | 1349 | 2-10-2 MOE | 30-40% | 36 |
| 400328 | 360 | 1453 | 1466 | 2-10-2 MOE | 10-20% | 13 |
| 400329 | 361 | 1454 | 1467 | 2-10-2 MOE | 10-20% | 14 |
| 400330 | 362 | 1455 | 1468 | 2-10-2 MOE | 40-50% | 43 |
| 400331 | 363 | 1456 | 1469 | 2-10-2 MOE | 30-40% | 35 |
| 400332 | 364 | 1569 | 1582 | 2-10-2 MOE | | 0 |
| 400333 | 365 | 1570 | 1583 | 2-10-2 MOE | | 0 |
| 400334 | 366 | 1571 | 1584 | 2-10-2 MOE | | 0 |
| 400335 | 367 | 1572 | 1585 | 2-10-2 MOE | | 0 |
| 400336 | 368 | 1573 | 1586 | 2-10-2 MOE | | 4 |
| 400337 | 369 | 1574 | 1587 | 2-10-2 MOE | | 0 |
| 400338 | 370 | 1575 | 1588 | 2-10-2 MOE | | 9 |
| 400339 | 371 | 1576 | 1589 | 2-10-2 MOE | | 0 |
| 400340 | 372 | 1577 | 1590 | 2-10-2 MOE | | 0 |
| 400341 | 373 | 1578 | 1591 | 2-10-2 MOE | | 0 |
| 400342 | 374 | 1621 | 1634 | 2-10-2 MOE | | 0 |
| 400343 | 375 | 1622 | 1635 | 2-10-2 MOE | | 0 |
| 400344 | 376 | 1623 | 1636 | 2-10-2 MOE | | 0 |
| 400345 | 377 | 1624 | 1637 | 2-10-2 MOE | | 0 |
| 400346 | 378 | 1738 | 1751 | 2-10-2 MOE | | 5 |
| 400347 | 379 | 1739 | 1752 | 2-10-2 MOE | | 0 |
| 400348 | 380 | 1740 | 1753 | 2-10-2 MOE | | 0 |
| 400349 | 381 | 1741 | 1754 | 2-10-2 MOE | 10-20% | 13 |
| 400350 | 382 | 1834 | 1847 | 2-10-2 MOE | 10-20% | 15 |
| 400351 | 383 | 1835 | 1848 | 2-10-2 MOE | 10-20% | 14 |
| 400352 | 384 | 1836 | 1849 | 2-10-2 MOE | 20-30% | 29 |
| 400353 | 385 | 1837 | 1850 | 2-10-2 MOE | 10-20% | 19 |
| 400354 | 386 | 1838 | 1851 | 2-10-2 MOE | 10-20% | 19 |
| 400355 | 387 | 1839 | 1852 | 2-10-2 MOE | | 0 |
| 400356 | 388 | 1840 | 1853 | 2-10-2 MOE | | 0 |
| 400357 | 389 | 2083 | 2096 | 2-10-2 MOE | | 0 |
| 400358 | 390 | 2084 | 2097 | 2-10-2 MOE | 10-20% | 12 |
| 400359 | 391 | 2085 | 2098 | 2-10-2 MOE | | 0 |
| 400360 | 392 | 2086 | 2099 | 2-10-2 MOE | 30-40% | 38 |
| 400361 | 393 | 2316 | 2329 | 2-10-2 MOE | | 2 |
| 400362 | 394 | 2317 | 2330 | 2-10-2 MOE | 10-20% | 16 |
| 400363 | 395 | 2318 | 2331 | 2-10-2 MOE | | 8 |
| 400364 | 396 | 2319 | 2332 | 2-10-2 MOE | | 0 |
| 400365 | 397 | 2320 | 2333 | 2-10-2 MOE | 20-30% | 25 |
| 400366 | 398 | 2321 | 2334 | 2-10-2 MOE | 10-20% | 15 |
| 400367 | 399 | 2322 | 2335 | 2-10-2 MOE | 10-20% | 12 |
| 400368 | 400 | 2323 | 2336 | 2-10-2 MOE | 10-20% | 11 |
| 400369 | 401 | 2324 | 2337 | 2-10-2 MOE | | 0 |
| 400370 | 402 | 2325 | 2338 | 2-10-2 MOE | 10-20% | 13 |
| 400371 | 403 | 3543 | 3556 | 2-10-2 MOE | | 0 |

As illustrated in Table 75, short antisense compounds targeted to a PCSK9 nucleic acid, having a 2-10-2 MOE gapmer motif, reduced PCSK9 mRNA in cultured cells.

Short antisense compounds targeted to a PCSK9 nucleic acid were tested in a dose response experiment Hep3B cells. Cells were treated as described herein with nM concentrations of short antisense compound as indicated in Tables 76. After the treatment period, RNA was isolated from the cells and PCSK9 mRNA levels were measured by quantitative real-time PCR, as described herein. PCSK9 mRNA levels were normalized to cyclophilin mRNA levels, as measured by real-time PCR using a cyclophilin-specific primer probe set. Results are presented as percent inhibition of PCSK9, relative to untreated control cells. Also shown is the $EC_{50}$ (concentration at which 50% reduction of mRNA is observed) for each short antisense compound tested in the dose response experiment, as calculated using Graphpad Prism. As illustrated in the following table, PCSK9 mRNA levels were reduced in a dose-dependent manner.

TABLE 76

Dose-dependent antisense inhibition of PCSK9 by short antisense compounds

| | % Inhibition | | | | | |
|---|---|---|---|---|---|---|
| | 160 nM | 80 nM | 40 nM | 20 nM | 10 nM | 5 nM |
| 5-10-5 | 95 | 96 | 85 | 78 | 58 | 38 |
| 400307 | 93 | 92 | 56 | 45 | 39 | 35 |
| 400308 | 86 | 77 | 40 | 26 | 10 | 31 |
| 400309 | 78 | 72 | 12 | 38 | 23 | 49 |
| 400327 | 55 | 43 | 49 | 23 | 37 | 5 |
| 400330 | 71 | 82 | 69 | 40 | 32 | 8 |
| 400331 | 82 | 75 | 63 | 47 | 40 | 29 |
| 400352 | 64 | 63 | 44 | 40 | 16 | 7 |
| 400353 | 48 | 54 | 43 | 23 | 27 | 15 |

Example 20

Antisense Inhibition of PCSK9 by Short Antisense Compounds Comprising BNAs

Short antisense compounds targeted to a PCSK9 nucleic acid were tested in dose response experiments, in both mouse and human cultured cells. The compounds tested included ISIS 403739 and ISIS 403740. ISIS 403739 is a short antisense compound consisting of the nucleotide sequence of SEQ ID NO: 404 and having a 2-10-2 gapmer motif, where the nucleotides in the wings comprise (6'S)-6'methyl BNA. ISIS 403740 is a short antisense compound consisting of the nucleotide sequence of SEQ ID NO: 405 and having a 2-10-2 gapmer motif, where the nucleotides in the wings comprise (6'S)-6'methyl BNA. Also tested was a 5-10-5 MOE gapmer targeted to a PCSK9 nucleic acid.

Mouse hepatocytes were plated and treated as described herein with nM concentrations of short antisense compound as indicated in Table 77. After the treatment period, RNA was isolated from the cells and PCSK9 mRNA levels were measured by quantitative real-time PCR, as described herein. PCSK9 mRNA levels were normalized to cyclophilin mRNA levels, as measured by real-time PCR using a cyclophilin-specific primer probe set. Results are presented as percent inhibition of PCSK9, relative to untreated control cells. Where present, "0" indicates no observed reduction in PCSK9 mRNA. ISIS 403739 exhibited dose-dependent reduction of mouse PCSK9 mRNA at the doses of 30 nM and higher. ISIS 403740 exhibited reduction of mouse PCSK9 mRNA at the two highest doses of short antisense compound.

TABLE 77

Antisense inhibition of mouse PCSK9 by short antisense compounds comprising BNAs

| | % Inhibition | | | | | | |
|---|---|---|---|---|---|---|---|
| | 3.75 nM | 7.5 nM | 15 nM | 30 nM | 60 nM | 120 nM | 240 nM |
| 5-10-5 | 10 | 15 | 21 | 18 | 44 | 43 | 77 |
| 403739 | 40 | 19 | 29 | 29 | 32 | 49 | 57 |
| 403740 | 3 | 0 | 29 | 13 | 0 | 40 | 33 |

Human Hep3B cells were treated with mM concentrations of short antisense compound as described herein. After the treatment period, RNA was isolated from the cells and PCSK9 mRNA levels were measured by quantitative real-time PCR, as described herein. PCSK9 mRNA levels were normalized to cyclophilin mRNA levels, as measured by real-time PCR using a cyclophilin-specific primer probe set. Results are presented as percent inhibition of PCSK9, relative to untreated control cells. The data are shown in Table 78 and demonstrate a dose-dependent reduction in human PCSK9 mRNA following treatment with ISIS 403740. ISIS 403739 exhibited dose-dependent reduction at higher doses.

TABLE 78

Antisense inhibition of mouse PCSK9 by short antisense compounds comprising BNAs

| | % Inhibition | | | | | | |
|---|---|---|---|---|---|---|---|
| | 2.5 nM | 5 nM | 10 nM | 20 nM | 40 nM | 80 nM | 160 nM |
| 5-10-5 | 7 | 2 | 21 | 33 | 30 | 59 | 71 |
| 403739 | 10 | 5 | 7 | 6 | 25 | 52 | 65 |
| 403740 | 6 | 12 | 16 | 29 | 45 | 48 | 59 |

Example 21

Antisense Inhibition of GCGR in HepG2 Cells

Short antisense compounds targeted to a GCGR nucleic acid were tested for their effects on GCGR mRNA in vitro.

HepG2 Cells

Cultured HepG2 cells at a density of 10000 cells per well in a 96-well plate were treated as described herein with 25, 50, 100 or 200 nM of antisense oligonucleotide. After the treatment period, RNA was isolated from the cells and GCGR mRNA levels were measured by quantitative real-time PCR, as described herein. GCGR mRNA levels were adjusted according to total RNA content as measured by RIBOGREEN®. Results are presented as percent reduction in GCGR mRNA, relative to untreated control cells.

Table 79 presents data following treatment with the indicated doses of ISIS 327161, a 3-10-3 MOE gapmer. ISIS 327161 reduced GCGR mRNA in a dose-dependent manner.

TABLE 79

Antisense inhibition of GCGR in HepG2 cells by a short antisense compound

| ISIS NO. | Seq ID NO | Sequence (5'-3') | Gapmer Motif | 25 nM | 50 nM | 100 nM | 200 nM |
|---|---|---|---|---|---|---|---|
| 327161 | 520 | AGCTGCTGTACATC | 3-8-3 MOE | -36 | -30 | -33 | -64 |

Monkey Hepatocytes

Additional short antisense compounds targeted to a GCGR nucleic acid were tested for their effects on monkey GCGR mRNA in vitro. Cultured primary monkey hepatocytes were treated as described herein with 25, 50, 100 or 200 nM of short antisense compound. After the treatment period, RNA was isolated from the cells and GCGR mRNA levels were measured by quantitative real-time PCR, as described herein. GCGR mRNA levels were adjusted according to total RNA content as measured by RIBOGREEN®. Results are presented in Table 80 as percent reduction in GCGR mRNA, relative to untreated control cells.

TABLE 80

Antisense inhibition of GCGR in primary monkey hepatocytes by short antisense compounds

| ISIS NO. | Seq ID NO | Sequence (5'-3') | Gapmer Motif | 25 nM | 50 nM | 100 nM | 200 nM |
|---|---|---|---|---|---|---|---|
| 327131 | 489 | ATGTTGGCCGTGGT | 3-8-3 MOE | 0 | -8 | -36 | -36 |
| 327161 | 520 | AGCTGCTGTACATC | 3-8-3 MOE | -19 | -33 | -55 | -54 |

Example 22

Antisense Inhibition of DGAT2 by Short Antisense Compounds

Short antisense compounds targeted to a DGAT2 nucleic acid were tested for their effects on DGAT2 mRNA in vitro. Cultured A10 cells in a 96-well plate were treated with 75 nM of short antisense compound. After a treatment period of approximately 24 hours, RNA was isolated from the cells and DGAT2 mRNA levels were measured by quantitative real-time PCR, as described herein. DGAT2 mRNA levels were adjusted according to total RNA content as measured by RIBOGREEN®. Results are presented as percent inhibition of DGAT2, relative to untreated control cells in Table 81.

TABLE 81

Antisense inhibition of DGAT2 in A10 cells

| ISIS NO. | Seq ID NO | Sequence (5'-3') | Gapmer Motif | % Control |
|---|---|---|---|---|
| 372491 | 795 | ACATGAGGATGACACT | 3-10-3 MOE | 80 |
| 372500 | 702 | GTGTGTCTTCACCAGC | 3-10-3 MOE | 16 |
| 372501 | 704 | TTGTGTGTCTTCACCA | 3-10-3 MOE | 28 |
| 372503 | 708 | GCAGGTTGTGTGTCTT | 3-10-3 MOE | 35 |
| 372508 | 719 | AGTTCCTGGTGGTCAG | 3-10-3 MOE | 35 |
| 372516 | 805 | TACAGAAGGCACCCAG | 3-10-3 MOE | 27 |
| 372524 | 738 | GCCAGGCATGGAGCTC | 3-10-3 MOE | 21 |
| 372530 | 746 | TCGGCCCCAGGAGCCC | 3-10-3 MOE | 35 |
| 372546 | 825 | TTGGTCTTGTGATTGT | 3-10-3 MOE | 34 |
| 372563 | 691 | AGCCAGGTGACAGA | 2-10-2 MOE | 48 |
| 372569 | 796 | CATGAGGATGACAC | 2-10-2 MOE | 104 |
| 372578 | 703 | TGTGTCTTCACCAG | 2-10-2 MOE | 59 |
| 372580 | 707 | GGTTGTGTGTCTTC | 2-10-2 MOE | 48 |
| 372586 | 720 | GTTCCTGGTGGTCA | 2-10-2 MOE | 40 |
| 372594 | 806 | ACAGAAGGCACCCA | 2-10-2 MOE | 77 |
| 372602 | 739 | CCAGGCATGGAGCT | 2-10-2 MOE | 39 |
| 372618 | 765 | GTGGTACAGGTCGA | 2-10-2 MOE | 29 |
| 372624 | 826 | TGGTCTTGTGATTG | 2-10-2 MOE | 56 |

Additional short antisense compounds targeted to DGAT2 mRNA were tested in vitro in a dose-response experiment. A10 cells were prepared as described above and treated with 6.25, 12.5, 25.0, 50.0, 100.0, and 200.0 nM short antisense compounds to determine if DGAT2 inhibition occurs in a dose-dependent manner. The data demonstrate that each of the short antisense compounds presented in Table 82 reduces rat DGAT2 mRNA in a dose-dependent manner. Results are presented as percent inhibition, relative to untreated control cells. A "0" indicates that DGAT2 mRNA was not reduced.

TABLE 82

Dose-Dependent Inhibition of DGAT2 in A10 cells

| ISIS NO. | Seq ID NO | Sequence (5'-3') | Gapmer Motif | 6.25 nM | 12.5 nM | 25.0 nM | 50.0 nM | 100.0 nM | 200.0 nM |
|---|---|---|---|---|---|---|---|---|---|
| 372562 | 784 | GTCTTGGAGGGCCG | 2-10-2 MOE | 0 | 0 | 0 | 36 | 48 | 75 |
| 372568 | 794 | GACACTGCAGGCCA | 2-10-2 MOE | 0 | 0 | 15 | 26 | 72 | 69 |
| 372586 | 720 | GTTCCTGGTGGTCA | 2-10-2 MOE | 19 | 0 | 7 | 22 | 45 | 77 |
| 372602 | 739 | CCAGGCATGGAGCT | 2-10-2 MOE | 0 | 0 | 0 | 18 | 47 | 76 |
| 372618 | 765 | GTGGTACAGGTCGA | 2-10-2 MOE | 0 | 5 | 0 | 27 | 65 | 80 |

Additional short antisense compounds targeted to DGAT2 mRNA were tested in vitro. A10 cells were prepared as described above and treated with 0.62, 1.85, 5.56, 16.67, 50.0, and 150.0 nM short antisense compounds to determine if DGAT2 inhibition occurs in a dose-dependent manner. DGAT2 mRNA was measured using quantitative real-time PCR, as described herein. The data demonstrate that each of the short antisense compounds presented in Table 83 below inhibit rat DGAT2 mRNA in a dose-dependent manner. Results are presented as percent inhibition of rat DGAT2, relative to untreated control cells. Where present, "0" indicates that no reduction in DGAT2 mRNA was observed.

TABLE 83

Dose-Dependent Inhibition of DGAT2 in A10 cells

| ISIS NO. | Seq ID NO | Sequence (5'-3') | Gapmer Motif | 0.62 nM | 1.85 nM | 5.56 nM | 16.67 nM | 50 nM | 150 nM |
|---|---|---|---|---|---|---|---|---|---|
| 372500 | 702 | GTGTGTCTTCACCAGC | 3-10-3 MOE | 0 | 0 | 0 | 18 | 64 | 88 |
| 372501 | 704 | TTGTGTGTCTTCACCA | 3-10-3 MOE | 1 | 5 | 10 | 11 | 25 | 68 |
| 372503 | 708 | GCAGGTTGTGTGTCTT | 3-10-3 MOE | 7 | 10 | 4 | 25 | 54 | 80 |
| 372508 | 719 | AGTTCCTGGTGGTCAG | 3-10-3 MOE | 0 | 0 | 6 | 14 | 39 | 71 |
| 372516 | 805 | TACAGAAGGCACCCAG | 3-10-3 MOE | 1 | 10 | 0 | 4 | 35 | 81 |
| 372524 | 738 | GCCAGGCATGGAGCTC | 3-10-3 MOE | 7 | 0 | 5 | 30 | 68 | 91 |
| 372530 | 746 | TCGGCCCCAGGAGCCC | 3-10-3 MOE | 0 | 2 | 0 | 10 | 38 | 78 |
| 372546 | 825 | TTGGTCTTGTGATTGT | 3-10-3 MOE | 0 | 2 | 11 | 4 | 48 | 78 |
| 372563 | 691 | AGCCAGGTGACAGA | 2-10-2 MOE | 0 | 0 | 0 | 1 | 4 | 46 |
| 372578 | 703 | TGTGTCTTCACCAG | 2-10-2 MOE | 0 | 0 | 0 | 2 | 7 | 42 |
| 372580 | 707 | GGTTGTGTGTCTTC | 2-10-2 MOE | 0 | 5 | 5 | 3 | 16 | 42 |
| 372586 | 720 | GTTCCTGGTGGTCA | 2-10-2 MOE | 0 | 0 | 0 | 0 | 7 | 55 |
| 372594 | 806 | ACAGAAGGCACCCA | 2-10-2 MOE | 0 | 0 | 0 | 0 | 2 | 15 |
| 372602 | 739 | CCAGGCATGGAGCT | 2-10-2 MOE | 0 | 0 | 10 | 0 | 19 | 51 |
| 372618 | 765 | GTGGTACAGGTCGA | 2-10-2 MOE | 0 | 0 | 0 | 0 | 30 | 60 |
| 372624 | 826 | TGGTCTTGTGATTG | 2-10-2 MOE | 0 | 0 | 0 | 1 | 16 | 38 |

Example 23

Antisense Inhibition of Human PTP1B in HuVEC Cells

Short antisense compounds targeted to a PTP1B nucleic acid were tested for their effects on PTP1B mRNA in vitro. Cultured HuVEC cells at a density of 5000 cells per well in a 96-well plate were treated as described herein with 3 nM of short antisense compound. After the treatment period, RNA was isolated from the cells and PTP1B mRNA levels were measured by quantitative real-time PCR, as described herein. PTP1B mRNA levels were adjusted according to total RNA content as measured by RIBOGREEN®. Results are presented as percent inhibition of PTP1B (% Inhib), relative to untreated control cells. The data demonstrated that short antisense compounds targeted to a PTP1B nucleic acid and having a 2-10-2 gapmer motif can inhibit PTP1B in HuVEC cells in Table 84.

TABLE 84

Antisense inhibition of PTP1B in HuVEC cells by short antisense compounds

| ISIS NO. | SEQ ID NO | Gapmer Motif | % Inhib |
|---|---|---|---|
| 399301 | 1542 | 2-10-2 OMe | 55 |
| 404137 | 1053 | 2-10-2 MOE | 76 |
| 404138 | 1054 | 2-10-2 MOE | 76 |
| 404139 | 1052 | 2-10-2 MOE | 80 |
| 404140 | 1051 | 2-10-2 MOE | 73 |

Example 24

Antisense Inhibition of Human PTP1B in HepG2 Cells

Short antisense compounds targeted to a PTP1B nucleic acid were tested for their effects on PTP1B mRNA in vitro. Cultured HepG2 cells at a density of 10000 cells per well in a 96-well plate were treated with 25 nM of antisense oligonucleotide. After the treatment period, RNA was isolated from the cells and PTP1B mRNA levels were measured by quantitative real-time PCR, as described herein. PTP1B mRNA levels were adjusted according to total RNA content as measured by RIBOGREEN®. Results are presented as percent inhibition (% Inhib) of PTP1B, relative to untreated control cells. The data demonstrated that short antisense compounds targeted to a PTP1B nucleic acid and having a 2-10-2 gapmer motif can inhibit PTP1B in HepG2 cells in Table 85.

TABLE 85

Antisense inhibition of PTP1B in HepG2 cells by short antisense compounds

| ISIS NO. | SEQ ID NO | Gapmer Motif | % Inhib |
|---|---|---|---|
| 399301 | 1542 | 2-10-2 OMe | 43 |
| 404137 | 1053 | 2-10-2 MOE | 71 |
| 404138 | 1054 | 2-10-2 MOE | 86 |
| 404139 | 1052 | 2-10-2 MOE | 45 |
| 404140 | 1051 | 2-10-2 MOE | 93 |

Example 25

Antisense Inhibition of PTP1B in HuVEC Cells: Dose Response Experiment

Human vascular endothelial (HuVEC) cells were plated at a density of 5000 cells per well and treated as described herein with nM concentrations of short antisense compound as indicated in Table 86. After the treatment period, RNA was isolated from the cells and PTP1B mRNA levels were measured by quantitative real-time PCR, as described herein. PTP1B mRNA levels were adjusted according to total RNA content as measured by RIBOGREEN®. Two different human PTP1B primer probe sets were used to measure mRNA levels. Results with Primer Probe Set (PPS) 198 are shown in Table 86, and results with Primer Probe Set (PPS) 3000 are shown in Table 87. Results are presented as percent inhibition of PTP1B mRNA expression relative to untreated control cells. Where present, "0" indicates that no PTP1B mRNA reduction was observed. As illustrated in Tables 86 and 87, PTP1B mRNA levels were reduced in a dose-dependent manner.

TABLE 86

Dose Response for Human PTP1B in HuVEC cells, using PPS 198

| | | | % Inhibition | | | |
|---|---|---|---|---|---|---|
| ISIS NO. | Seq ID NO | Gapmer Motif | 1.11 nM | 3.33 nM | 10.0 nM | 30.0 nM |
| 398105 | 1066 | 2-10-2 MOE | 0 | 25 | 79 | 90 |
| 398112 | 1072 | 2-10-2 MOE | 1 | 10 | 73 | 93 |
| 398120 | 1086 | 2-10-2 MOE | 0 | 31 | 80 | 96 |
| 399096 | 1544 | 2-10-2 MOE | 3 | 30 | 78 | 96 |
| 399102 | 1545 | 2-10-2 MOE | 0 | 15 | 62 | 88 |
| 399113 | 1547 | 2-10-2 MOE | 0 | 31 | 72 | 90 |
| 399132 | 1548 | 2-10-2 MOE | 0 | 32 | 75 | 95 |
| 399173 | 1549 | 2-10-2 MOE | 0 | 24 | 63 | 89 |
| 399208 | 1550 | 2-10-2 MOE | 0 | 37 | 86 | 93 |
| 399276 | 1551 | 2-10-2 MOE | 0 | 8 | 61 | 89 |
| 399301 | 1542 | 2-10-2 MOE | 8 | 63 | 91 | 97 |
| 399315 | 1552 | 2-10-2 MOE | 0 | 20 | 68 | 88 |
| 398173 | 1543 | 1-10-1 MOE | 0 | 4 | 80 | 97 |

TABLE 87

Dose Response for Human PTP1B in HuVEC cells, using PPS 3000

| | | | % Inhibition | | | |
|---|---|---|---|---|---|---|
| ISIS NO. | Seq ID NO | Gapmer Motif | 1.11 nM | 3.33 nM | 10.0 nM | 30.0 nM |
| 398105 | 1066 | 2-10-2 MOE | 0 | 35 | 79 | 93 |
| 398112 | 1072 | 2-10-2 MOE | 0 | 26 | 77 | 94 |
| 398120 | 1086 | 2-10-2 MOE | 0 | 35 | 79 | 93 |
| 399096 | 1544 | 2-10-2 MOE | 0 | 23 | 75 | 94 |
| 399102 | 1545 | 2-10-2 MOE | 0 | 9 | 60 | 87 |
| 399113 | 1547 | 2-10-2 MOE | 0 | 9 | 65 | 90 |
| 399132 | 1548 | 2-10-2 MOE | 0 | 26 | 76 | 91 |
| 399173 | 1549 | 2-10-2 MOE | 0 | 11 | 59 | 92 |
| 399208 | 1550 | 2-10-2 MOE | 0 | 47 | 85 | 96 |
| 399276 | 1551 | 2-10-2 MOE | 0 | 14 | 64 | 86 |
| 399301 | 1542 | 2-10-2 MOE | 16 | 65 | 93 | 99 |
| 399315 | 1552 | 2-10-2 MOE | 0 | 25 | 71 | 93 |
| 398173 | 1543 | 1-10-1 MOE | 0 | 18 | 80 | 90 |

Example 26

Antisense Inhibition of ApoB by Short Antisense Compounds

The short antisense compounds shown in Table 88 were tested for their effects in vivo. Six-week old male Balb/c mice (Jackson Laboratory, Bar Harbor, Me.) were administered intraperitoneal doses of 3.2, 1, 0.32, or 0.1 umol/kg, twice per week for three weeks. A 5-10-5 MOE gapmer was used for a control treatment. Mice were sacrificed approximately 48 hours following the final dose. Liver tissue was collected for RNA isolation, and blood was collected for serum chemistry analyses. ApoB mRNA levels were measured by real-time PCR as described herein. ApoB mRNA levels were normalized to RNA levels as determined by RIBOGREEN, and are presented in Table 89 as percent inhibition relative to ApoB mRNA levels in saline-treated control animals.

TABLE 88

Short Antisense Compounds Targeting an ApoB nucleic acid

| ISIS NO | Sequence (5'-3') | Gapmer Motif | SEQ ID NO |
|---|---|---|---|
| 387462 | GGTACATGGAAGTC | 2-10-2 Methyleneoxy BNA | 190 |
| 398296 | GGTACATGGAAGTC | 2-10-2 6'-(S)-methyl Methyleneoxy BNA | 190 |

TABLE 89

Antisense inhibition of ApoB by Short Antisense Compounds Comprising BNA

| Isis No | Dose (umol/kg) | % Inhib |
|---|---|---|
| 379818 | 1 | 56 |
| 387462 | 0.1 | 33 |
|  | 0.32 | 57 |
|  | 1 | 93 |
|  | 3.2 | 99 |
| 398296 | 0.1 | 17 |
|  | 0.32 | 35 |
|  | 1 | 80 |
|  | 3.2 | 98 |

Table 89 shows that ApoB mRNA levels were reduced in a dose-dependent manner following treatment with short antisense compounds having a 2-10-2 gapmer motif and BNA modifications in the wings. At the 1 umol/kg dose, ApoB inhibition by the short antisense compounds was greater than observed with a 5-10-5 MOE gapmer at an equivalent dose. Cholesterol was reduced at the 1 and 3.2 umol/kg doses of short antisense compound.

The short antisense compounds exhibited little to no adverse side effects, as judged by organ and body weights, serum transaminases, bilirubin, blood urea nitrogen, and creatinine.

Example 27

Antisense Inhibition of PTEN by Short Antisense Compounds

The short antisense compounds shown in Table 90 were tested for their effects in vivo. Six-week old male Balb/c mice (Jackson Laboratory, Bar Harbor, Me.) were administered intraperitoneal doses of 3.2, 1, 0.32, or 0.1 umol/kg, twice per week for three weeks. A 5-10-5 MOE gapmer was used for a control treatment. Mice were sacrificed approximately 48 hours following the final dose. Liver tissue was collected for RNA isolation, and blood was collected for serum chemistry analyses. PTEN mRNA levels were measured by real-time PCR as described herein. PTEN mRNA levels were normalized to RNA levels as determined by RIBOGREEN, and are presented in Table 91 as percent inhibition relative to PTEN mRNA levels in saline-treated control animals.

TABLE 90

Short Antisense Compounds targeted to a PTEN nucleic acid

| ISIS NO | Sequence (5'-3') | Gapmer Motif | SEQ ID NO |
|---|---|---|---|
| 392063 | AGGCCAGTGCTAAG | 2-10-2 Methyleneoxy BNA | 1226 |
| 392749 | AGGCCAGTGCTAAG | 2-10-2 (6'S)-6'-methyl Methyleneoxy BNA | 1226 |
| 396006 | AGGCCAGTGCTAAG | 2-10-2 alpha-L-methyleneoxy BNA | 1226 |

TABLE 91

Antisense inhibition of PTEN by short antisense compounds comprising BNA modifications

| Isis No | Dose (umol/kg) | % Inhib |
|---|---|---|
| 116847 | 1 | 47 |
| 392063 | 0.1 | 26 |
|  | 0.32 | 43 |
|  | 1 | 74 |
|  | 3.2 | 96 |
| 392749 | 0.1 | 17 |
|  | 0.32 | 34 |
|  | 1 | 64 |
|  | 3.2 | 96 |
| 396006 | 0.1 | 20 |
|  | 0.32 | 32 |
|  | 1 | 67 |
|  | 3.2 | 88 |

Table 91 shows that PTEN mRNA levels were reduced in a dose-dependent manner following treatment with short antisense compounds having a 2-10-2 gapmer motif and BNA modifications in the wings. At the 1 umol/kg dose, PTEN inhibition by the short antisense compounds was greater than observed with a 5-10-5 MOE gapmer at an equivalent dose.

With the exception of the highest dose of ISIS 392063, no significant increases in serum transaminases were observed. Overall, the short antisense compounds exhibited little to no adverse side effects.

Example 28

Single Dose Administration of Short Antisense Compounds Comprising BNA Modifications Six-week old male Balb/c mice (Jackson Laboratory, Bar Harbor, Me.) were administered a single intraperitoneal injection of short antisense compound at a dose of 8, 4, 2 or 1 pµmol/kg. The short antisense compounds tested were ISIS 387462 and ISIS 398296. Each dose group consisted of four animals. A 5-10-5 MOE gapmer was used for a control treatment. Mice were sacrificed approximately 48 hours following the final dose. Liver tissue was collected for RNA isolation, and blood was collected for serum chemistry analyses. ApoB mRNA levels were measured by real-time PCR as described herein. ApoB mRNA levels were normalized to RNA levels as determined by RIBOGREEN, and are presented in Table 92 as percent inhibition relative to ApoB mRNA levels in saline-treated control animals.

TABLE 92

Antisense inhibition of ApoB by Short Antisense Compounds Comprising BNA

| Isis No | Dose (umol/kg) | % Inhib |
|---|---|---|
| 379818 | 8 | 77 |
| 387462 | 8 | 99 |
|  | 4 | 93 |
|  | 2 | 81 |
|  | 1 | 58 |
| 398296 | 8 | 97 |
|  | 4 | 81 |
|  | 2 | 54 |
|  | 1 | 19 |

Table 92 shows that ApoB mRNA levels were reduced in a dose-dependent manner following a single administration of short antisense compounds having a 2-10-2 gapmer motif and BNA modifications in the wings. At the 8 umol/kg dose, ApoB inhibition by the short antisense compounds was greater than observed with a 5-10-5 MOE gapmer at an equivalent dose. The $ED_{50}$ of ISIS 387462 was 3.9 mg/kg, and the $ED_{50}$ of ISIS 398296 was 8.7 mg/kg. Cholesterol was also reduced in a dose-dependent manner. Triglycerides were reduced at the highest dose.

The short antisense compounds exhibited little to no adverse side effects, as judged by organ and body weights, serum transaminases, bilirubin, blood urea nitrogen, and creatinine.

In a similar single dose administration study, ISIS 392748, having SEQ ID NO: 1226, a 2-10-2 gapmer motif, where the nucleotides of the wings comprise (6'R)-6'-methyl methyleneoxy BNA modifications, reduced PTEN mRNA in a dose-dependent manner. Additionally, ISIS 392749, having SEQ ID NO: 1226, a 2-10-2 gapmer motif, where the nucleotides of the wings comprise (6'S)-6'-methyl methyleneoxy BNA modifications, reduced PTEN mRNA in a dose-dependent manner. A short antisense compound having 2-10-2 gapmer motifs, the sequence of SEQ ID NO: 1226, and 6-(S)—CH$_2$—O—CH$_3$-BNA modifications also reduced PTEN mRNA in a similar in vivo study. A short antisense compound having 2-10-2 gapmer motifs, the sequence of SEQ ID NO: 1226, and 6-(R)—CH$_2$—O—CH$_3$-BNA modifications also reduced PTEN mRNA in a similar in vivo study.

Example 29

Single Dose Administration of Short Antisense Compounds Comprising BNA Modifications Six-week old male Balb/c mice (Jackson Laboratory, Bar Harbor, Me.) were administered a single intraperitoneal injection of antisense compound at a dose of 8, 4, 2 or 1 pµmol/kg. Each dose group consisted of four animals. The compounds tested were ISIS 392063, ISIS 392749, and ISIS 366006. A 5-10-5 MOE gapmer was used for a control treatment. Mice were sacrificed approximately 48 hours following the final dose. Liver tissue was collected for RNA isolation, and blood was collected for serum chemistry analyses. ApoB mRNA levels were measured by real-time PCR as described herein. ApoB mRNA levels were normalized to RNA levels as determined by RIBOGREEN, and are presented in Table 93 as percent inhibition relative to ApoB mRNA levels in saline-treated control animals.

TABLE 93

Antisense inhibition of PTEN by short antisense compounds comprising BNA modifications

| Isis No | Dose (umol/kg) | % Inhib |
|---|---|---|
| 116847 | 8 | 62 |
| 392063 | 8 | 92 |
|  | 4 | 82 |
|  | 2 | 58 |
|  | 1 | 38 |
| 396565 | 8 | 76 |
|  | 4 | 38 |
|  | 2 | 24 |
|  | 1 | 11 |
| 396006 | 8 | 94 |
|  | 4 | 82 |
|  | 2 | 48 |
|  | 1 | 18 |

Table 93 shows that PTEN mRNA levels were reduced in a dose-dependent manner following treatment with short antisense compounds having a 2-10-2 gapmer motif and BNA modifications in the wings. At the 8 umol/kg dose, PTEN inhibition by the short antisense compounds was greater than observed with a 5-10-5 MOE gapmer at an equivalent dose. The estimated $ED_{50}$s were 7 mg/kg for ISIS 392063, 17.4 mg/kg for ISIS 396565, and 9.3 mg/kg for ISIS 396006.

With the exception of the highest dose of ISIS 392063, no significant increases in serum transaminases were observed. Overall, the short antisense compounds exhibited little to no adverse side effects.

Example 30

Antisense Inhibition of ApoB by Short Antisense Compounds Comprising Palmitic Acid Conjugates Six-week old male Balb/c mice (Jackson Laboratory, Bar Harbor, Me.) were administered a single intraperitoneal injection of antisense compound at a dose of 2.5, 1.0, 0.4, and 0.16 umol/kg. Each dose group consisted of four animals. The compounds tested are shown in Table 94. A 5-10-5 MOE gapmer was used for a control treatment. Mice were sacrificed approximately 48 hours following the final dose. Liver tissue was collected for RNA isolation, and blood was collected for serum chemistry analyses. ApoB mRNA levels were measured by real-time PCR as described herein. ApoB mRNA levels were normalized to RNA levels as determined by RIBOGREEN, and are presented in Table 95 as percent inhibition relative to ApoB mRNA levels in saline-treated control animals.

TABLE 94

Short antisense compounds comprising palmitic conjugates

| ISIS NO | Sequence (5'-3') | Gapmer Motif | SEQ ID NO |
|---|---|---|---|
| 387462 | GGTACATGGAAGTC | 2-10-2 Methyleneoxy BNA | 190 |
| 391871 | GGTACATGGAAGTC | 1-1-10-2 2'-(butylacetomido)-palmitamide/MOE/MOE Unmodified cytosines in gap (i.e., 2-10-2 MOE with 2'-(butylacetomido)-palmitamide substituted at 5' nucleotide | 190 |
| 391872 | GGTACATGGAAGTC | 1-1-10-2 2'-(butylacetomido)-palmitamide Methyleneoxy BNA/Methyleneoxy BNA Unmodified cytosines in gap (i.e., 2-10-2 methyleneoxy BNA with 2'-(butylacetomido)-palmitamide substituted at 5' nucleotide) | 190 |

TABLE 95

Antisense inhibition by short antisense compounds comprising palmitic acid conjugates

| Isis No | Dose (umol/kg) | % Inhib |
|---|---|---|
| 5-10-5 | 2.5 | 54 |
| 387462 | 2.5 | 99 |
|  | 1.0 | 91 |
|  | 0.4 | 65 |
|  | 0.16 | 16 |
| 391871 | 2.5 | 49 |
|  | 1.0 | 18 |
|  | 0.4 | 5 |
|  | 0.16 | 0 |
| 391872 | 2.5 | 99 |
|  | 1.0 | 92 |
|  | 0.4 | 50 |
|  | 0.16 | 18 |

Table 95 shows that ApoB mRNA levels were reduced in a dose-dependent manner following treatment with short antisense compounds having a palmitic acid (C16) conjugate. At the 2.5 umol/kg dose, ApoB inhibition by the short antisense compounds was greater than observed with a 5-10-5 MOE gapmer at an equivalent dose. In this study, the estimated $ED_{50}$s were 1.5 mg/kg for ISIS 387462, 13.1 mg/kg for ISIS 391871, and 1.9 mg/kg for ISIS 391872. The estimated $ED_{50}$ for the 5-10-5 MOE gapmer was 17.4 mg/kg. Triglycerides were reduced at the 2.5 and 1.0 mg/kg doses of ISIS 387462 and ISIS 391872. ISIS 387462 and ISIS 391872 markedly reduced total cholesterol, HDL-C and LDL-C in a dose-dependent manner; reduction in LDL-C was so marked that it fell below the limit of detection. Overall, the short antisense compounds exhibited little to no adverse effects.

Example 31

Antisense Inhibition of PCSK9 In Vivo by Short Antisense Compounds Comprising BNA Modifications Six-week old male Balb/c mice (Jackson Laboratory, Bar Harbor, Me.) were administered a single intraperitoneal injection of antisense compound at a dose of 15, 4.7, 1.5 and 0.47 umol/kg of ISIS 403739 or 403740. Each dose group consisted of four animals. A 5-10-5 MOE gapmer was used for a control treatment. Mice were sacrificed approximately 72 hours following the final dose. Liver tissue was collected for RNA isolation, and blood was collected for serum chemistry analyses. PCSK9 mRNA levels were measured by real-time PCR as described herein. PCSK9 mRNA levels were normalized to cyclophilin mRNA levels as determined by real-time PCR. ISIS 403739 reduced PCSK9 mRNA by approximately 70%, relative to saline controls. ISIS 403740 reduced PCSK9 by approximately 13% relative to saline controls, however, the reduction was not statistically significant. The lower doses did not significantly reduce PCSK9 mRNA. Overall, the short antisense compounds exhibited little to no adverse side effects.

SEQUENCE LISTING (1576 sequences)

SEQ ID NO: 1 - DNA, 14121 bp, H. sapiens
attcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaacaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctcaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctgaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtagtggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttgacccaccaatacaagttgaaggagactattcagaagctaagcaatgtcctacaacaagttaagataaaagattactttgagaaattggttggatttattgatgatgctgtgaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtcgaaatgaaagtaaagatcatcagaaccattgaccagatgcagaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattactcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacacttgcacaccgtgacttcagtgcagaatatgaagaagatggcaaatttgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaaaaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcaatgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcata

SEQ ID NO: 2 - DNA, 13928 bp, Mus musculus
atcagtgcctgcagtggatcaagtacctgcctgagctccgcctccgaagaccctgtagagcaagcagcaggggctaggcccgtggccaggccacagccaggaagccaccccaccatccatccgccatgggcccacgaaagcctgccctgcggacgccgttactgctgctgttcctgctactgttcttggacaccagcgtctgggctcaagatgaagtcctggaaaacttaagcttcagctgtccaaaagatgcaactcgattcaagcacctccgaaagtacgtgtacaactatgaagctgaaagttccagcggtgtccagggcacagctgactccagaagcgccaccaagatcaactgtaaggtagagctggaggtcccccaaatctgtggtttcatcatgaggaccaaccagtgtacccttaaagaggtgtatggcttcaaccctgagggcaaggccttgatgaagaaaaccaagaactctgaagagtttgcagctgccatgtccaggtacgaactcaagctggccattcctgaagggaaacaaattgttctttaccctgacaaggatgaacctaaatatatcctgaacatcaagaggggcatcatctctgctcttctggttcccccagagacagaagaggaccaacaagagttgttcctggataccgtgtatggaaactgctcaactcaggttaccgtgaattcaagaaagggaaccgtaccaacagaaatgtccacagagagaaacctgcagcaatgtgacggcttccagcccatcagtacaagtgtcagccctctcgctctcatcaaaggcctggtccaccccttgtcaactcttatcagcagcagccaaacttgccagtacaccctggatcctaagaggaagcatgtgtctgaagctgtctgtgatgagcagcatcttttcctgcctttctcctacaagaataagtatgggatcatgacacgtgttacacagaaactgagtcttgaagacacacctaagatcaacagtcgcttcttcagtgaaggtaccaaccggatgggtctggcctttgagagcaccaagtccacgtcatccccaaagcaggctgatgctgttttgaagacccttcaagaactgaaaaaattgtccatctcagagcagaatgctcagagagcaaatctcttcaataaactggttactgagctgagaggcctcactggtgaagcaatcacatccctcttgccacagctgattgaagtgtccagccccatcactttacaagccttggttcagtgtggacagccacagtgctatactcacatcctccagtggctgaaaactgagaaggctcaccccctcctggttgacattgtcacctacctgatggctctgatcccaaatccctcaacacagaggctgcaggaaatctttaatactgccaaggagcagcagagccgagccactctgtatgcactgagccacgcagttaacagctattttgatgtggaccattcaaggagcccagttctgcaggatatcgctggttacctgttgaaacagatcgacaatgaatgcacgggcaatgaagaccacaccttcttgattctgagggtcattggaaatatgggaagaaccatggaacaagtaatgccagccctcaagtcctcagtcctgagctgtgtacgaagtacaaaaccatctctgctgattcagaaagctgctctccaggccctgaggaagatggaactggaagatgaggtccggacgatcctttttgatacatttgtaaatggtgtcgctcccgtggagaagagactggctgcctatctcttgctgatgaagaacccttcctcatcagatattaacaaaattgcccaacttctccaatgggaacagagtgagcaggtgaagaacttcgtggcatctcacattgccaacatcttgaactcggaagaactgtatgtccaagatctgaaagttttgatcaaaaatgctctggagaattctcaatttccaacgatcatggacttcagaaaattttcccgaaactatcagatttccaaatctgcttctctcccaatgttcgacccagtctcagtcaaaatagaagggaatcttatatttgatccaagcagttatcttcccagagaaagcttgctgaaaacaaccctcacagtctttggacttgcttcacttgatctctttgagattggtttagaaggaaaagggtttgagccaacactagaagctctttttggtaagcaaggattcttcccagacagtgtcaacaaggctttgtattgggtcaatggccgagttccagatggtgtctccaaggtcttggtggaccactttggctatactacagatggcaagcatgaacaggacatggtgaatggaatcatgcccattgtggacaagttgatcaaagatctgaaatctaaagaaattcctgaagccagggcctatctccgcatcctaggaaaagagctaagctttgtcagactccaagacctccaagtcctggggaagctgttgctgagtggtgcacaaactttgcagggaatcccccagatggttgtacaggccatcagagaagggtcaaagaatgacttgtttctccactacatcttcatggacaatgcctttgagctccccactggagcagggttacagctgcaagtgtcctcgtctggagtcttcacccccgggatcaaggctggtgtaagactggaattagccaacatacaggcagagctagtggcaaagccctctgtgtccttggagtttgtgacaaatatgggcatcatcatcccagacttcgctaagagcagtgtccagatgaacaccaacttcttccacgagtcaggcctggaggcgcgagtggccctgaaggctgggcagctgaaggtcatcattccttctccaaagaggccagtcaagctgttcagtggcagcaacacactgcatctggtctctaccaccaaaacagaagtgatcccacctctggttgagaacaggcagtcctggtcaacttgcaagcctctcttcactggaatgaactactgtaccacaggagcttactccaacgccagctccacggagtctgcctcttactacccactgacaggggacacaaggtatgagctggagctgaggcccacgggagaagtggagcagtattctgccactgcaacctatgaactcctaaaagaggacaagtctttggttgacacattgaagttcctagttcaagcagaaggagtgcagcagtctgaagctactgtactgttcaaatataatcggagaagcaggaccttatctagtgaagtcctaattccagggtttgatgtcaacttcgggacaatactaagagttaatgatgaatctgctaaggacaaaaacacttacaaactcatcctggacattcagaacaagaaaatcactgaggtctctctcgtgggccacttgagttatgataaaaagggagatggcaagatcaaaggtgttgtttccataccacgtttgcaagcagaagccaggagtgaggtccacacccactggtcctccaccaaactgctcttccaaatggactcatctgctacagcttacggctcaacaatttccaagagagtgacatggcgttacgataatgagataatagaatttgattggaacacgggaaccaatgtggataccaaaaaagtggcctccaatttccctgtggatctttcccattatcctagaatgttgcatgagtatgccaatggtctcctggatcacagagtccctcaaacagatgtgacttttcgggacatgggttccaaattaattgttgcaacaaacacatggcttcagatggcaaccaggggtcttccttacccccaaactctacaggatcacctcaatagcctctcagagttgaacctcctgaaaatgggactgtctgacttccatattccagacaacctcttcctaaagactgatggcagagtcaaatacacaatgaacaggaacaaaataaacattgacatccctttgcctttgggtggcaagtcttcaaaagacctcaagatgccagagagtgtgaggacaccagccctcaacttcaagtctgtgggattccatctgccatctcgagaggtccaggtccccacttttacaatccccaagacacatcagcttcaagtgcctctcttgggtgttctagacctttccacaaatgtctacagcaatttgtacaactggtcagcctcctacactggtggcaacaccagcagagaccacttcagccttcaggctcagtaccgcatgaagactgactctgtggttgacctgttttcctacagtgtgcaaggatctggagaaacaacatatgacagcaagaacacatttacattgtcctgtgatggatctctacaccataaatttctagactcaaaattcaaagtcagccacgtagaaaaatttggaaacagcccagtctcaaaaggtttactaacatttgaaacatctagtgccttgggaccacagatgtctgctactgttcacctagactcaaaaaagaaacaacatctatacgtcaaagatatcaaggttgatggacagttcagagcttcttcattttatgctcaaggcaaatatggcctgtcttgtgagagagatgttacaactggccagctgagcggcgaatccaacatgagatttaactccacctacttccagggcaccaaccagatcgtgggaatgtaccaggatggagccctgtccatcacctccacttctgacctgcaagatggcatattcaagaacacagcttccttgaaatatgaaaactatgagctgactctgaaatctgatagcagtgggcagtatgagaacttcgctgcttccaacaagctggatgtgaccttctctacgcaaagtgcactgctgcgttctgaacaccaggccaattacaagtccctgaggcttgtcacccttctttcaggatccctcacttcccagggtgtagaattaaatgctgacatcttgggcacagacaaaattaatactggtgctcacaaggcaacactaaagattgcacgtgatggactatcaaccagtgcgaccaccaacttgaagtacagccccctgctgctggagaatgagttgaatgcagagcttgggctctctggggcatccatgaaattatcaacaaacggccgcttcaaagaacaccatgcaaaattcagtcttgatgggagagctgccctcacagaggtgtcactggggagcatttaccaggccatgattctgggtgcagacagcaaaaacatcttcaacttcaaactcagccgagaagggctgaggctgtccaatgatttgatgggctcctatgctgagatgaaacttgaccacacacacagtctgaacattgcaggtctctcactggacttcttctcaaaaatggacaatatttacagtggagacaagttctataagcagaattttaacttacagctacagccctattctttcataactactttaagcaacgacctgagatatggtgctctagatttgaccaacaatggaaggtttcggctggagccactgaagctgaatgtgggtggcaactttaaaggaacctatcaaaataatgagctgaaacatatctataccatatcttatactgacctggtagtagcaagttacagagcagacactgtggctaaggttcagggtgtcgaattcagccataggctaaatgcagacattgaaggactgacttcctctgttgatgtcactaccagctacaattcagatccactgcattttaacaatgttttccacttttctctggcaccttttaccttgggcatcgacacacatacaagtggtgatgggaaactgtccttctggggagaacacactgggcagctatatagtaagtttctgttgaaagcagaacctctggcacttattgtctctcatgactacaaaggatccacaagccacagtctcccgtacgagagcagcatcagcacggctcttgaacacacagtcagtgccttgctgacgccagctgagcagacaagcacctggaaattcaagaccaaactgaatgacaaagtatacagccaggactttgaagcctacaacactaaagacaaaatcggtgttgagcttagtggacgggctgacctctctgggctgtattctccaattaaactaccgtttttctacagtgagcctgtcaatgtccttaatggcttagaggtaaatgatgctgttgacaagccccaagaattcacaattattgctgtggtgaagtacgataagaaccaggatgttcacaccatcaacctcccattcttcaaaagcctgccagactatttggagagaaatcgaagaggaatgataagtctactggaagccatgcgaggggaattgcaacgcctcagtgttgatcagtttgtgaggaaatacagagcggccctgagcagacttcctcagcagattcatcattatctgaatgcatctgactgggagagacaagtagctggtgccaaggaaaaaataacttctttcatggaaaattatagaattacagataatgatgtactaattgccatagatagtgccaaaatcaacttcaatgaaaaactctctcaacttgagacatacgcgatacaatttgatcagtatattaaagataattatgatccacatgacttaaaaagaactattgctgagattattgatcgaatcattgaaaagttaaaaattcttgatgaacagtatcatatccgtgtaaatctagcaaaatcaatccataatctctatttatttgttgaaaacgttgatcttaaccaagtcagtagtagtaacacctcttggatccaaaatgtggattccaattatcaagtcagaatccaaattcaagaaaaactacagcagctcaggacacaaattcagaatatagacattcagcagcttgctgcagaggtaaaacgacagatggacgctattgatgtcacaatgcatttagatcaattgagaactgcaattctattccaaagaataagtgacattattgaccgtgtcaaatactttgttatgaatcttattgaagattttaaagtaactgagaaaatcaatacttttagagttatagtccgtgagctaattgagaaatatgaagtagaccaacacatccaggttttaatggataaatcagtagagttggcccacagatatagcctgagcgagcctcttcagaaactcagtaatgtgctacagcgaattgagataaaagattactatgagaaattggttgggtttattgatgatactgttgagtggcttaaagcattgtctttcaaaaataccattgaagaactaaatagattgactgacatgttggtgaagaagttgaaagcatttgattatcaccagtttgtagacaaaaccaacagcaaaatccgtgagatgactcagagaatcaatgctgaaatccaagctctcaaacttccacaaaaaatggaagcattaaaactgttggtagaagacttcaaaaccacagtctccaattccctggaaagactcaaggacaccaaagtaactgtggtcattgattggctgcaggatattttgactcaaatgaaagaccatttccaagatactctggaagatgtaagagaccgaatttatcaaatggacattcagagggaactggagcacttcttgtctctggtaaaccaagtttacagtacactggtcacctatatgtctgactggtggactctgactgctaaaaacataacagactttgcagagcaatattccatccaaaactgggctgagagtataaaagtactggtggaacaaggattcatagttcctgaaatgcaaacatttctgtggaccatgcctgcttttgaggtcagtctccgtgctctccaagaaggtaactttcagacccctgtctttatagtccccttgacagatttgaggattccatcaattcggataaactttaaaatgttaaagaatataaaaatcccattgagattttccactccagaattcactcttctcaacaccttccatgtccattcctttacaattgacttgctggaaataaaagcaaagatcattagaactatcgaccaaattttgagcagtgagctacagtggcctcttccagaaatgtatttgagagacctggatgtagtgaacattcctcttgcaagactgactctgccagacttccatgtaccagaaatcacaattccagaattcacaatcccaaatgtcaatctcaaagatttacacgttcctgatcttcacataccagaattccaacttcctcacctctcacatacaattgaaatacctgcttttggcaaactgcatagcatccttaagatccaatctcctctctttatattagatgctaatgccaacatacagaatgtaacaacttcagggaacaaagcagagattgtggcttctgtcactgctaaaggagagtcccaatttgaagctctcaattttgattttcaagcacaagctcaattcctggagttaaatcctcatcctccagtcctgaaggaatccatgaacttctccagtaagcatgtgagaatggagcatgagggtgagatagtatttgatggaaaggccattgaggggaaatcagacacagtcgcaagtttacacacagagaaaaatgaagtagagtttaataatggtatgactgtcaaagtaaacaatcagctcacccttgacagtcacacaaagtacttccacaagttgagtgttcctaggctggacttctccagtaaggcttctcttaataatgaaatcaagacactattagaagctggacatgtggcattgacatcttcagggacagggtcatggaactgggcctgtcccaacttctcggatgaaggcatacattcgtcccaaattagctttactgtggatggtcccattgcttttgttggactatccaataacataaatggcaaacacttacgggtcatccaaaaactgacttatgaatctggcttcctcaactattctaagtttgaagttgagtcaaaagttgaatctcagcacgtgggctccagcattctaacagccaatggtcgggcactgctcaaggacgcaaaggcagaaatgactggtgagcacaatgccaacttaaatggaaaagttattggaactttgaaaaattctctcttcttttcagcacaaccatttgagattactgcatccacaaataatgaaggaaatttgaaagtgggttttccactaaagctgactgggaaaatagacttcctgaataactatgcattgtttctgagtccccgtgcccaacaagcaagctggcaagcgagtaccagattcaatcagtacaaatacaatcaaaacttttctgctataaacaatgaacacaacatagaagccagtataggaatgaatggagatgccaacctggatttcttaaacatacctttaacaattcctgaaattaacttgccttacacggagttcaaaactcccttactgaaggatttctccatatgggaagaaacaggcttgaaagaatttttgaagacaacaaagcaatcatttgatttgagtgtaaaggctcaatataaaaagaacagtgacaagcattccattgttgtccctctgggtatgttttatgaatttattctcaacaatgtcaattcgtgggacagaaaatttgagaaagtcagaaacaatgctttacattttcttaccacctcctataatgaagcaaaaattaaggttgataagtacaaaactgaaaattcccttaatcagccctctgggacctttcaaaatcatggctacactatcccagttgtcaacattgaagtatctccatttgctgtagagacactggcttccagccatgtgatccccacagcaataagcaccccaagtgtcacaatccctggtcctaacatcatggtgccttcatacaagttagtgctgccacccctggagttgccagttttccatggtcctgggaatctattcaagtttttcctcccagatttcaagggattcaacactattgacaatatttatattccagccatgggcaactttacctatgacttttcttttaaatcaagtgtcatcacactgaataccaatgctggactttataaccaatcagatatcgttgcccatttcctttcttcctcttcatttgtcactgacgccctgcagtacaaattagagggaacatcacgtctgatgcgaaaaaggggattgaaactagccacagctgtctctctaactaacaaatttgtaaagggcagtcatgacagcaccattagtttaaccaagaaaaacatggaagcatcagtgagaacaactgccaacctccatgctcccatattctcaatgaacttcaagcaggaacttaatggaaataccaagtcaaaacccactgtttcatcatccattgaactaaactatgacttcaattcctcaaagctgcactctactgcaacaggaggcattgatcacaagttcagcttagaaagtctcacttcctacttttccattgagtcattcaccaaaggaaatatcaagagttccttcctttctcaggaatattcaggaagtgttgccaatgaagccaatgtatatctgaattccaagggtactcggtcttcagtgaggctacaaggagcttccaaagttgatggtatctggaacgttgaagtaggagaaaattttgctggagaagccaccctccaacgcatctacaccacatgggagcacaatatgaaaaaccatttgcaggtatatagctacttcttcacaaaaggaaagcaaacatgcagagctactttggagctctccccatggaccatgtcaaccttgctacaggttcatgtgagtcaactcagttccctccttgacctccatcactttgaccaggaagtgatcctaaaagctaacactaagaaccagaagatcagctggaaaggtggggtccaggttgaatcacgggttcttcagcacaatgcacagttctccaatgaccaagaagaaatacggcttgaccttgcaggatccttagacggacagctgtgggaccttgaagctatctttttaccagtatatggcaagagcttgcaggaactcctacaaatggatggaaagcgacagtatcttcaagcttcaacttctcttctatataccaaaaaccctaatggctatctcctctcactccccgtgcaagaactggctgatagatttattataccagggataaaactaaatgacttcagtggagtaaaaatctataagaagttaagtacttcaccatttgccctcaacctaacaatgctccccaaagtaaaattccctgggattgatctgttaacacagtactctacaccagagggctcctctgtccctatttttgaggcaactatacctgaaattcatttaactgtatcccagtttacacttccaaagagccttccagttggcaacacagtctttgatctgaataagttggccaacatgattgccgatgttgacctgcctagtgtcaccctgcctgagcagactattgtaatcccacccttggagttctctgtacctgctgggatttttattcctttctttggagaactgactgcacgtgctgggatggcttctcccctgtataatgtcacttggagcgctggttggaaaaccaaagcagatcatgttgaaacgttcctagattccatgtgcacttcaaccttgcagtttctggagtatgctttaaaagttgtagaaacacacaaaattgaagaagatctgttaacctataatatcaaaggaacacttcaacactgtgacttcaatgtggagtataatgaagatggtctatttaaaggactttgggactggcagggagaggctcacctggacatcaccagcccagcactgactgactttcatctgtactacaaagaagacaagacaagtctgtctgcctcagcagcctcctcgaccatcggcactgtgggtctggattcgagcacagatgaccagagtgtggagctgaatgtctacttccacccacagtcccctccagagaagaaactcagcatattcaaaactgagtggaggtacaaggagtctgatggtgaaaggtacatcaaaattaattgggaagaagaggcagcttccagattgctaggctccctaaaaagcaatgtgcccaaggcttctaaggctatttatgattatgccaataagtaccacctggaatacgtttcttcagaactaagaaaaagtctacaggtcaatgctgaacatgccagaaggatggttgatgaaatgaacatgagtttccagagagtagcccgtgatacctaccagaatctctatgaggagatgttggctcagaagagcctgagcatccctgagaatctcaagaagagggtgttagacagtatagtacatgttactcagaagtaccacatggcagtcatgtggctgatggactcattcattcattttctgaaattcaatagagtccagttcccagggtacgctggaacatatactgtggacgaactctacactatagtcatgaaggaaaccaagaagtcactgtctcagctgtttaatgggttaggaaacctactttcctacgttcaaaaccaagtagagaaatcaagattaatcaatgacataacatttaaatgtccttttttctcaaaaccttgtaaactaaaagatctcatattgattttcagggaggagttaaacattttatcaaacataggccaacaggatatcaagtttacaacaatactaagtagtcttcagggctttttggagagagttttagacatcatagaagaacaaattaaatgcctaaaggacaatgaatctacttgtgttgctgaccatatcaacatggttttcaaaatacaggtcccatatgcttttaaatccctaagagaagacatatactttgtcctcggtgagttcaatgactttcttcaatccatacttcaggaggggtcctacaagctacagcaggtccatcagtatatgaaggcccttcgtgaagagtattttgatccgagcatggttgggtggacagtgaaatattatgaaatagaagaaaatatggttgagctgatcaagacccttttagtttcctttagggatgtctactctgaatatagtgtgacagctgctgattttgcttccaaaatgtcaactcaagttgaacaatttgtgtccagggatatcagagagtatcttagcatgcttactgatataaatggaaagtggatggaaaagattgcagagctttctattgtggcaaaggaaacaatgaaaagctgggtcactgccgtggccaaaataatgtctgattacccccagcagttccactccaatctgcaggatttttcagaccaactctctagctactatgaaaaatttgttggtgagtccacaagattgattgacctgtccattcaaaactaccacgtgtttctcagatacatcaccgagttactgagaaagctgcaggtggccacagccaataatgtgagcccctatataaagcttgctcaaggagagctgatgatcaccttctgattcatctactaacaaattcaaattaaaccttcacatagtaggagactttgtagactactataaagaccatcctgagccagacctgcagtcaacagcaagagcaagaagcacataggaactatacctgcaaccaagctggcataagaaccaagaccttcaaagcagcctgaactcaagatgacatattttacaagttagagtaaagtcaagagctgagttgttttgtccaactcaggatggagggagggagggaaggggaaataaataaatacttccttattgtgc

SEQ ID NO: 3 - DNA, 2273 bp, H. sapiens
gggggcagatcctggggagaatggaggagcacacagaggcaggctcggcaccagagatgggggcccagaaggccctgattgacaatcctgctgacatcctagtcattgctgcatatttcctgctggtcattggcgttggcttgtggtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtgcggcacggaggtgggctgctccaacatcgcctacccgcggctcgtcgtgaagctcatgcccaacggtctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgctgctggtgggacggctctgggtggtgttcatcgtggtagtgtcggtggcctggcttcccgtggtgcaggcggcacagggcgggcagctcttcgattacatccaggcagtctctagctacctggcaccgcccgtgtccgccgtcttcgtgctggcgctcttcgtgccgcgcgttaatgagcagggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacctccaccgcctggtcttcagtctccggcatagcaaggaggaacgggaggacctggatgctgatgagcagcaaggctcctcactccctgtacagaatgggtgcccagagagtgccatggagatgaatgagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgta

SEQ ID NO: 4 - DNA, 3636 bp, H. sapiens
cagcgacgtcgaggcgctcatggttgcaggcgggcgccgccgttcagttcagggtctgagcctggaggagtgagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgcgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcct

SEQ ID NO: 5 - DNA, 874 bp, H. sapiens
ctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattc

SEQ ID NO: 6 - DNA, 1631 bp, H. sapiens
ggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccggggtacagtattttctcgtatgccaccaagagacaagacaatgagattcttcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagcattgcccacattcacagggctcttcagtatcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaacacaggtgccgtg

SEQ ID NO: 7 - DNA, 1898 bp, Mus musculus
cggacgcgtgggcgaggaccgcgaggagcgcagccctagccccggcgactgagcacacctgaggagaggtgcacacactctgaggacctaggtgtgcaacctctgccagatgtggggcgtggctacccagaggcatgcccctcacccagctccactgtccccacctgctgctgctgctgttggtgctgtcatgtctgccagaggcaccctctgcccaggtaatggactttttgtttgagaagtggaagctctatagtgaccaatgccaccacaacctaagcctgctgcccccacctactgagctggtctgtaacagaaccttcgacaagtactcctgctggcctgacacccctcccaacaccactgccaacatttcctgcccctggtacctaccttggtaccacaaagtgcagcaccgcctagtgttcaagaggtgtgggcccgatgggcagtgggttcgagggccacgggggcagccgtggcgcaacgcctcccaatgtcagttggatgatgaagagatcgaggtccagaagggggtggccaagatgtatagcagccagcaggtgatgtacaccgtgggctacagtctgtccctgggggccttgctccttgcgctggtcatcctgctgggcctcaggaagctgcactgcacccgaaactacatccatgggaacctgtttgcgtcctttgtgctcaaggctggctctgtgttggtcatcgattggctgctgaagacacggtacagccagaagattggcgatgacctcagtgtgagcgtctggctcagtgacggggcgatggccggctgcagagtggccacagtgatcatgcagtacggcatcatagccaactattgctggttgctggtagagggcgtgtacctgtacagcctgctgagccttgccaccttctctgagaggagcttcttttccctctacctgggcattggctggggtgcgcccctgctgtttgtcatcccctgggtggtggtcaagtgtctgtttgagaatgttcagtgctggaccagcaatgacaacatgggattctggtggatcctgcgtattcctgtcttcctggccttactgatcaattttttcatctttgtccacatcattcaccttcttgtggccaagctgcgtgcccatcagatgcactatgctgactataagttccggctggccaggtccacgctgaccctcatccctctgctgggggtccacgaggtggtctttgcctttgtgactgacgagcatgcccaaggcaccctgcgctccaccaagctcttttttgacctgttcctcagctccttccagggtctgctggtggctgttctctactgtttcctcaacaaggaggtgcaggcagagctgatgcggcgttggaggcaatggcaagaaggcaaagctcttcaggaggaaaggttggccagcagccatggcagccacatggccccagcagggccttgtcatggtgatccctgtgagaaacttcagcttatgagtgcaggcagcagcagtgggactggctgtgtgccctctatggagacctcgctggccagtagtctcccaaggttggctgacagccccacctgaatctccactggagcctagccaggctgcgttcagaaagggcctcagaggacaacccagagccagatgcccggccaaggctgaagagacaaagcagcaagacagcagcttgtactgtgcacactcccctaacctgtcctagcctggcacaggccacagtgacagagtaggggttggatatgatggagaagccatgttatctatgaactctgagtgttcccatgtgtgttgacatggtccctgtacccagatatgtccttcagtaaaaagctcgagtgggaaaaaaaaaaaaaaaaaaaaaaaaaaaaa

SEQ ID NO: 8 - DNA, 106000 bp, H. sapiens
aagcttatggtttatgggtgttacattcaagacatttgtaggacacattctaaaatgccatccaatttcaggctctttccagcagaaactgtggaatatttttccgttcattcagcatttacttagtgcctgctctgccaggaattgaagagaaagcccaaagacaggcagaccttacctgagaggtagtgaactgaccaggatgactgtgggcagtagacttgtttcccaaactagcctcaccatttctgtatttgcatatacgaggaaaggattagatatagggattcatgtcagcatacaccccagggacatttgtttttagtgaaaggtgccagtcttcatccctgtacccagtacacaaaccacgaagaagtatgctcccgtcattgtcaaagaatcatagaattccaaatggagctagttttgatatccagatctcacttcatatgaggaaactaggtccagtattgtgagtaagaattaggactcttcagattccctgggtatgaatctgactaacaactgtgtgaacttgaccaaattcataaccctgtaaactctgtttcctcacttttaaaatgggcacaacaaagtgatgcatgtaaactgcatagcacagtgtctggcacttaaaaagcactcctgaagttatttttagtgatgtgttttaagattagacaactccttaatgccaaaggtttttacttgagaactctgtctgtgtgccatactacacgctgttcataagataagcctttttcattaattgatctcaaactggcttcattatgatcttaactttatttcagttttatttttaaaatttatttttaatttttatgggtatatagtaggcatatatatttatggggtacaggtcatgttttaatgcaagcatgcaattgtgggggtgatatataattgactggggtgagatatctcattgtagttttgatttgcatttctctgatgattaaggatgttgaacatttcttcatacacctgttggccatttgtatgtcttttgagaaatgtctattcagatcttttgtccattttttaagttggattgtttgattttttcctgttgtctgaactctttatatattctagttattaatcccttctcagatgggtagcttgcaaatattttcttccattttgtgggttgcttctttgttgtttccgttgctgtgcagaagttttttagcttgatgtgatcccatttgtccatttttgcattggttgcctgtgcatttgaggtattactaaagaaatctttgcccataccagtgtcctggagagcttcccaaatgttttcttttagtatcctagtttcaggtcttagatttagggctttagtccatttttatttgatttttatatgtggtgagagataggggtctagtttcattctgcctatggatatccagttttcccagcaccatttattgaagagactgtcctttccctagtgtatgttcttggcacctttgctgaaaatgagttcactgtaggtgtatgaatttgtttctgggttctctaggtctgtgtatctgtttttatgctagaactatgttgtttgggttattatagttttgtagcataatttgaagtcagataatgtaattcctccagttttattttttttgttcaggatggctttggctattccggggcttttgtggttccatataaatcctatgattttttttttctatttctgtgaagaatgtcattgatatttattaataaagattgcattgaatctgtagattgctttgggtagtatggacattttaacaatattgattcttccaatccatgagcatggactatctttctttttttgtgtgtcctcttcaatatttttcctcagtgttttattgttttcattgtagagctctttcacttctttcgttgagtttattcctaggtgttttattttatctgtagctattgtaaatgagattactttctgatttcttttttagattgtcctctgttggcatctagaaatgccacagatttttgtatgttgattttgtatcctgtaactgtactgaatttatctgttctaatatttttttggtggagtctttaggcttttccaataagatcatacagtctgcaaacaagaataatttgacttcttccattccattttggattccctttatatctttctcttgtctgattactctaggtaggtcttccagtacttccagttgaataacagtgggcactcttgtcttgttgtagatcttagaagaaaggctttcagtttttccccattcagtatgatactagctgtcagtttgttgcagatggcataactttcaaactaattgattatagttaggaagtggatactttaacttgtggtaccattatcagatttatatttcggccataagcttgaagaggagctgaaaaatgcatatgtgatgcatatgcttcctatttggctctcttctcccacccccctgccctataatccacacaagttcctctctcagtcactcatcaactacttgaacctctgaggaacttggggttaaggtaaattagaataaaactgtctgaagaagagcaagcctttcatgtcttgagaaattcttggggttttagaaataacttcattgctttttttctccagttactttggcttcttcttaaagagaatactaacactttgaacgtcataatactaaggttctgcctcttcaaataaagactttaaaaaaaaatggtttttgtatgattcagtgtgaattaaatcccacagtgtaaaggactttactttcttaatgtagattttcaaatacacaattactgatgtttataagtagatttattacaccaaagcacctagcaaattcttgaatggatcaggtcttatttttcagtcttactttgcaaatttaagccaaataattaaggatttgttaaatatttgtcttaatatcaagcttttgcatatcggggccctcttttataagctttataagcaatcttttgttttctctgcttgctcaaagtagctatgtttgttgtatctgttagtatttgctctataacaaacatactgggtgccttcccacttagatttggcaattatcactcctgtaaatgagatattacataagataggaaaaagaacagtatctttccaagaagaatagtatccttccatattaacagtttagagctgactgcttttaaaatttagtggctttaaaataacaaccatttattattcttcatgagtctacaaatgaggtgggcagttctgctgatctggccaagctgaacttatctcagctgggcacattcagcgtatctgctgtcagttggctggttggctgtagcaatgaatggtgaaagtaggctgcccttaactttttcacacagtagcattagagttacaaaagaaccagcagaaccatgcaaaactctttaagacctaggcttggaacaactatatttctaccacattctattggtcaaagcaaatcacggggctagtctagattcaagtgggtggaggagctgcaattacactgcaaaggagtgtgactgtagggagaggtgtttttttatttttatttttttgcgatttgtcacagtagttgtaggaatcaggtgtatttaaaattctgatccttctgtgatatccgaattgttcatgaaccttgcctctggtggaaaggcagaatcattgtgacagaaggataaaatcttggaatttagagactaacaaaggttcagattccagctccatcacttatttctgcaatcctgcagaagttaatcttcctgataggcattcagtaatgattgattcacctgaacctcagattctttatgtattttaaagaaagggctaggtaaatgcaaagcacttatgtaactgcttttattattgcaaacctggctcccacactccattcaaggtgtaagactcagtgtcttccttgaattaaaaaggaagagaaagtgtgttagggaaaggaagagaaatatttgactaattgtggccccaataaagtgaccactcactgggggtattttcctgtaagaaaagaatggttgaggctcagagttaagagatacaaatccaaaagtctccttggggtaggattccctgtgattcatgggttgagaggtgtaacattagacacagtcccagtctagattttttttttaaagaattgtggtccatcctatacacactgggtgccttaatactatatgtggcaattatcactcctataaatcaggttttacataagataggaaaaagaacagtatcattccacattaacaattgaaagatgactgcttttaaaaaattaaaagggccatatagaaataaaatcacataaatttcttgtgttaaacatagttgtcatattggatgaggactaaacacctaaattcatccaactagtagtaatagaaaagatgaaacacacacacagtaaaactagattaatttaatttatacaaagggccagatatctcagaattcagacagtcagagatgttgactagagttaatgcctcttttaggagaggtaccaggtaagtgttctcaaagaactggaaactgagaccaccacctctggcattatctgtttgtgaacacaagcaagtctgaatttttccgcaccatagctacctttcatgtaagcttcttttcttagaagaaaagaaggtaacatttgggtgtaattttttattaagggtgaaatttagtgtagagagtaaaggcatttggcatagaagcccttagttttttttgtttttaagttgaactgccagcctttatggattgcagtcttcgctgttttgattgacatttcccaattcattttgtattatttatttttttaagagacagggtctcactctgttacccaggctggagtgcaatggggcaaacttggatcactgcagccttgaactcctgggctcaagcaatcctcccacctcagcctcccaagtagcttggactataggtgtgcaccaccatccttggctaattttttaaatcttttgtagagacagggtagtgctctgttgcccaggctggtctcacattcctggcctcagttgatgctctggtctcagccttccaaaatgctgggattacaagtgtgagccactgcacctggcccccaatttcatcctttacaaagactactttcaaccataaatcaacggaaacttcagctccctcagacatatttgggatccaaggatattttcccaaatgattaatgctaatttcatatcaatacatttttgcaaaacctacaaaaatggactagtaaagaaagactcttaatttgggaaagacagttacttggagagaagagaaacttaagaggcaggtcgagttcagtgttcagaaatgagaggatcataaagagatagccataaaaatgtttctccctatattgcctgctgatagggtgtatcagtgaaggtcttactaaggaccttgtaccttttcagcgctgcactgcgtgctcatagggaggaaagataaatcatgtgttttttctgacctcaaaggagcctgtatctggctagagagacatgatgcagacacatgaaataattaagaaacaattaactgtagcaggtgctgaagaatataccaggaggtcagagaatggtagagctagtgtgggcgaaggtatagcccagagcatcatcagatgattcttccttatgcaaattcacatctcctctgggtcaagtatcatcctggcatgcagcagctccataggtaatgccctaaggctagcctgaggcaagttgcaaaagccatcatattgagtcatggcctttttttgtgtggggggaggggaatggcatccccttcctgtctgccaaatcaaggaatacagtgccctcctaaacctgctttgttttagtggattgttaaaaagaagtgaatgaatttatgcttcattagggaaaggttacagtggaatactgaggagtaaggggtatttctatttaacaaatgacataacttgaaggaatgaaatcataaggatggaatttcaggcattaataaaaagctgatgagagatactttgagacaaaagagccttcccagtgtaaccgagatcacagcacctacttcacatacacaggaaaccagtcctatctgtctctcccatagagcagtagctgccttgtttttcctccctcctccatcattcattctaaatctccagtcctccaccgcaccttatccaaaccctgatacccttaagtcacagatggtgaatcagtcaaaagtagtattaaaaactagtggtacacagctacacctggaatgcagtaagaaaaatacggatttctgtacatcatcttccctccctgctcttacccccatttaagagttacagggtcagaacccaagagtgtgagtttttgaaagtccctaaaaattttggatgatcacctacatttagaaccactgcactaagaaggacaacaaatatgccaataaattctgttgccaaggaggtgattatgcaagctggaaccctgataacatgaggagaatcccacaatagccaaatagtccatgtactagttacattataataaagccaaaagcagcaggcctacctgactttctcctgaggtctatcatgagcttagagagaaggaacgtggacatacagaggtagctctagatggagaagggcactaggtgtcatggaaagaatcatgtgcaagaagtaaagaggtgctctgaatgtcctagccctgcttaggtgtctgtgtcctcacatgagaatttatccacagttctttcccgctgtaacaatctttggttccaactgcatttgtgagacagcaaaaagctatggtccagtctccttccattgtatcatctcatcaatgtatttctcccactacccttgtgtgaaatacaaacttttttggcttattgtgattatgcaaggtgtatgccaacttttttttttctccacatctttcagctttctgatgggtaaaaattttccttattttgctttagaaaaattctcattggcatagatctaatttcagggagcctcccttgaaagctaaataacattgagaattcatgaaaatataatgtagagcattatgcctgttagcatattagtttaaatagaagtggttcatgaaaatttttgaaatgccagaccctgtcctgtgttttgtattctcccaaatactcatccagatactgttcagaatgtaacatgattattttgaaataaagattttcccctagtttttaaaaaagttactttatacattaacccttatgttcctctttgatcaatttttccagtagtgtaaacagtcttcagggaagtagatttcttacagaaattgtcaagtggctctctgctgttagcatggttactaatcttttggttacttttcatattttttatactttctggaagtggacaacttacttgtaaataaaagtgcataatttgtattaaaaatttttagtaacaatctaatttgtaaaatagatgtgagcagcatgaatgtgtgtgatatgcgtacatacgaattatgtctcttaaaaatgtatcacagacatctttccgtgtccaaacaaatctacctcattctttctaatagccatatgggtataccataatatatttaactaggcccctattaaaagaattttgactcttttgtagctactatagtgttgcagtgtgtatctgtgtatgtatctttgtgtgtgtatctttgtacgagtgtacatatattttccccttggctatttcagatttttttttaggtttaaatcttaggaaaggttttgaaattgtcttaagtattttcagaagcattaaatcatggtttttttacatttttcttttagaagttttatgtcatctctatgagtagctttcagtaatttgttctgcataaaattcccgaaaacttccatttaaaaataggtggcatgactagactttctcagccgaaagagtgaggtcccaggaaggattttggagaagctgtgttcaaatatagctgctgacctgatgtctgcctagagtctggcaaggtgatgtgttgaatctagtgtctgcctgcatgccagcatccctttactgatgagatttgtggttttcatcacttcatggtaatcatcccaagttataagatggagtctctagaaaatcagtagagtatgaaggcccaagtaaaatacatgtgagtgcatgtatgtgtgcatacaaattacttctcttaaaaacgtatcctgggcatttaaagaatgaggacctccgaaggattttgtggaagctgtgttcaagtacagctgctgagcgtatgtcagcctggagcctggcaaggtgaagtgttgaatctagtgtctttttgactcactgttttttttgactcactgtgctttgaagcccttgtcatttgggctcataaaatagatttctgtatactgtctctcctccctgccctcgcccccatttaaaagtatagtggcagaacccaagaatcagagttactaaaaactctctagaaaatttggatgatcacccacctgatcatgtcttttttactcactatgttttttttttttttgagacagagtctcgctctgtcgcccaggctggagtgcagtggcatgatcttggctcactgcaagctccgcctccctggttcacgccattctcctgcctcagcctcccatgtagctgggactacagggcctgccaccgcgcccggctaattttttgtatttttagtagagtcggggtttcactgtgttagccaggatggtcccgatctcctgacctcgtgatccacccgcctcggcctcccaaagtgctgggattacaggcgtgagccaccacacccggccctttactcactatgtttttaagcccttgttttcatttgctccactgtaaaacattccccaagccaatctggagctgaggcaaatttttaacaatttaaaatctggggaatataaatattggataatgatcatcctgaaaaaacaatgaaggtagtagcataatactttatatatcaataaaatggcaaaataagacagttgttgaaggacagaaagagtaactgaagttaggagcttatcttaacacattttttgtgtcataccataggcatcatattttttaaattttttttatttcatacacataggaaaatatatgtgtgtaagaaataataaacacctctttgtacctaccacccaacttaaggaacagctcattgctattccctttggtgctcgctggatgccctttcccagtcacatccccctcccttcccatctgcaggactatactagtaaattttgtattttttgcattattttgctttgttttatgattttactacctatctacatatccctaaataatacattatttagtttcatatgttttaactttatgttgtggaatcacattaaatgtagtcttttttttttatattatactttaagttctagggtacatgtgcacaacgtgcaggtttgttacgtaggtatacatgcgccatgttggtttgctgcacccatcaactcgtcatttacactgggtatttctcctaatgctatccctcccctagccccccaccccccgataaatgtagtctttataacttgtttttttaactcaacattgtttgtaagattcatccatgtaagctgaagcttttttatagagatctttgttaagccttttaatgaatacagtacatacatttctctgttcccctgttagtggacacttggattgtttccagagttttgctgttttgaacaacgctgctgtgaaaatgtctcctgaaacacatttataagagtttttttttccccaagggaattatacctagaaattgaataactagatcacaaggcatacacatctacaacttctgctaggtaatgccaaattgtttccaaggagcgttagaagtgttctcatcaacttttactagtgctagtcttttacatttgtggcagtatggtgggtgtgaaatatttatgtttagtttttcttggtgccatttaataatttttataaaaaatatttagaagtcaaggcagttttttgtttttgtttttattttttgcttgttttgttttaatgcagacattgagattacgacttggaataaacattggttgcaaagttcctaaaaggaaaactttttttggtattctggagcttttctggtactgaataaaataagtatgttaaattatgcatgtgtagtttagaagtcagagcaataattgtgattgttgaacagaatggcagtaaaaagtttctaaacgattgtactgtacaagggacacttgttgtgggtcagttttagcctccccaacttttatgttaaaagttgcaacaaggtttaagggcttatgtttgataggccagatggtgaccagctgtgataaaacacagggaacccttgcaaaggatttcaaaatttatgcagtagtccgccttatctgcagttttgctttccaaggtttcagttacccgcagtcaactgtgttctgaaaatattaagtgaaaaattacagaaataaagaatcgaagagttttaaattttatgcttcccacccatcccacctgggatgtgaatcattcctttgttcagcatctccatgctgtaggtgctgcctgccccttagtcacttggtagccatccaggttatcagattgactcttctagtattacaacacttggcttcaagtaatccttattttacttcatagtggccccaaagtgcaggagtggtgatcctggcaattcagatatgtcaaagagaagctgtaaattgcttcccttaagtgaaagatgaaaattctagacttatatataaagaaaagaaatcatatgctgagactgctaagatctatgataagaatgaatcttttatacatgaaattgtgaagaatgaaaaagaaatgcgtgctggttttgctgtcatatctcagactgcaaaagtttgcagccaatgtgtatgataagtgcttagttaaaaggaaaaaggcatttaaggtaagtatatatagtgtttggtactacctgtgatttcaggcatccattgggggtctcctgagtataaggggagactactcttttagtgttaaatgaacactaaggaacagagatggggaagaggttggagaagattagttcagcagtttgagtataggtaaacagttgtttgagaaagaagaaaaatgtgattagtattttaccttagcaatagtggcatagataatgataaattatagtcacacagaactcttagtatttacagaacgttcacatttgtgatcccatttaacaataactctgaaagaaaggtatcatctaccactgctttattgataaagatataaaaggtaagagagatgaaacatattggccaatgatacccatctggtaagagacagggatggggtgggaccccaaggctcttctcgccaagcccacggtttttttgctttatacttttttgcctcctgatcaccatggctgcagtttctactgtggacaatgtctgtcagcaagcattgatcccctgccttcagcactcttacgtcttagcaaggactggaaagaaaaagccaggagtttacagtctgctggagcaacagaaaagaatgatatgaaatatgaagagaccaaaatgatttataataaggtgctagactatgtagtaaaaatctgctttagctgtaagtcaaaagcaagagcagtcttttcagaatggaatagaaatgttggaattaaaggaattttcaaagttgtgaatttttttcaagataaacatgttttattttggtaattatggtattactaatttgataaccttcagggagccacctaatattatagaagatgtacatataatgacaaaagcaaacattttatttttaaggaccacaatctaatctaaaacaaaatttcccccttttctggtctttggttaattaaggacttatttaaatatcaaagaaagacacatagaaaacatttagtatatttctatacttttattaatgtcctccataccttacacagatacttgacttggctatggtctagataatccatgaaaatttaaaggacagattttaacaactttatgctaaattgatagatctctaggatcagattgccatcactctcagatgcgaagcttccaaccacttataggttcctgatatcttgcttttatacagacctaatttctcttcctttaaactttcttttcctcagttgctatttgattgaaatattgagtcattaaaaatttccaagtgggaatttttgtgtttcttcatctatcatgaagctgctcaaataagtaggtgtttgaataggagtagaaacagtaataggctgaagccagaccaatacagcttcagctaaatgccgaccttgctaaagtctgggaggaccggtgtggtattctacaatgtacaagtctgtagccggtgcccttaatatgttggcttcatgtctcatgactctcttctgtaaatatgcagtttaaaaaatacaagttattctgctgtagaagatacatttgcaaaattgatgtatcccctctaagtaaagttggctaaacaataaggacatatttataattaatgaatttgagaagaatgctgacgatatgcattattctttgaagttaacatttttcaggtcctaaataaacaaaaagtaggttacttctgtctggagtgtatgcaaggggtaccatcttgtccttggttcctggctgctattccaaggtgctataaagtcagctaaagagagcaatcataatacattgatagcatccctcaatgtgtttctgagctacttgagaatcttatttttgaataggtagcaggaaaccatctttgcagggcagcatgggcaaagggattggagggactattattataaagatccactgaactgcttcagtatcataatatcttaaactaaaggactggaaagagccagattccaatttaatctgctcttctatgaattcttagctgggttcatttaaaaagaaaaaacttgaagattgcaagattttgaagacatcttaaaataggtgaactccaaggtgcactttaaacttgagactgataactgaatactccttcaccttttgatctgatattgtcaaaatgaatgaggacttagtgctctagtaagtttggaacagaatgatattaatttattttctcatgattgattcttttttgctttttaatagattaaacttcaccgtagaacagtttctcaacctctggactattgacatttttgattggataattctttgctgtcagggctgttctgtgtgttgcaggatagttagcaacatccctgacaatcacaaatgttactttctgtctctatggatttgcctattctggacatttcgtataaatagaatcatatatatgtggcttcttgtacctggcttatttcacttaacatgttttcaaggttcatccatattgtagcatgtaacagcacttcattttctttttatggctgagtaatattctgttatgtggatatactaccatattttgtctatccactccttagctgatggtcttttaggttgtgtccattctttggctattataaataatgctgttaagaacattcatatacaagtttctgtgtagacatatatctttatttctcttgtgtggatacctaggagtagaattactggatcatatgataactctatgtgttaccttttgaggaactgccaaacatttttctacagtggctgtatcattttacactcccatcagcaatgtataagaattccaatttctctgtccttgcctatatttattaactgtcttttcttattagccaactgctgtggttcgaatgtttgtcccctccaaaactcatgttggaacataatccccaatgtggcagtattgagatgtgaggcctttaagaagtgcttgggtcatcagaggtctgccctcatgaataggctaatccattcatgagttaatgtactaatgggttatcactggattgggactagtggctttataagaagaggaagagaactaatctagtaagctcagccttctcactatgtgattgctgccctgtgtcaccttgggactctgcagagagtcctccagcagcaagaagttcttcatcagctgtggccccttgaccttggacttcccagcctccagaaatgtaagaaatccatttcttttttttaataaattacacagtctcacgtattcagttataccaacagaacacagactaagacaccatcctattgggtatgggtatctcattgtgttttttatttgtgtctcccaaatgactaacgatgttgaacatcttttcatctgctttttggacatttgtgtattttctttgaagaaatgtctttaacattctttgcccattttaaaattaggttgtctttttattgttgagttgtcggtgtgtgtgtgtgtgtgtgtgtgtgtgtgtgtatctagaatatatgtgtatgtatatatgcagatatattctaaacactagacccttatgaaatatataatttgaggacaatttctcccatttaaaaggccatcttttcacttcttgatagtgtcatttgactcacaagtttttaatttttatgaagtccaatttattttttaattctttgtttttggcactgtatctttaaaaagttgcctgatctaaggtcaaactgattttcacctatgttttcatctaagaattatagttttagctcttacatttaggcctttgatccattttgaattaatttgtgtatatggtgtgaagtagggctctaacttattcttttgtgtaatgatacctagttgtcccagcaccatttgttgaaaagattattctttccccattgaatggtcttgataccttgttgaaatcaactgaccataaatatataggcttattcctggactcacaattctatgagtctgtatgtctaatcttatgccagtaccacactgttttgattattacatctttgtacaaagttttgaaattgggaaatgtgagtcttccaactttgttcttttttaagattactttgcctatattccgtgttcgttgcaaactcatatgaattttaaatcaactctccatttctggaagaaaaaaagaggcaattgaagttcagatagggattgcattgaacctgtagatcagtttggggaatattgccatcataacaattagtaggtcttccaacccatgaatacaagacttctttccatttctgtagatatttagtttctttcattaatattttgtagttttcaatataaaagtcttgtacttcgattaaatttattcttgaatattttgggttttgatgcttttatgaatttgttttcttaatttcactttaagattgttcattgctactgattagtaatgcaactgatttttgtgtgttgatttttgtatcctgcaacctagctgaaatcattgattagcataatagagtatttaatagatttaggatttctatatataagatcatgtcatctgcaattagagataattttacttcttccctttcaatctggacattttttacttctttttcttgcctagttgccctagctagaacctccagtgcagtgttgaatagcagtggtgagaatgagcatctttgtgttggtcttcatcttgtggggaaacctttcagtttaagtgtgttgttgtggggttttcatagttgtcctttatcagattgagaatgttcctttctgttcctagtttgttgagtgttttctttttgattgttttaatcaggaaagggcattagattttgtcaaatgctttttctgcagctattgagatttttgtgtgtttttctggtcttttatggtttatcacattaattgattttcatatgtcaaacaaaccctgtgttcttgggtttcatctcacttggttatggtttataatcctttttatatacttgtagattcagtttgccagtattttgttgaggatgcttgcatttatatttataagggatattggtctgttgtagctgaccagtaagtatagtaagctgtatagtttactaagtgttccctctgttttgggggagactttgagaagaaggattgttggtaattgttctttaaacatttggtaaaattcactagtgaagccatctggggtcttctttggaagttttttgattactaacttaatgtctttacttgtttgttataagtccattcagatttttttctccttgagtcatttttgacagttggttgaggaatttgttcatttcatgtagttatctaattggttagtgtataattattcatagtattcctttataatcttatttttttgctgtaaggtcagtcataatgttcactctttcatttcggattctggtaatttaagagtcttctctccttttttttcttggtcagtctagctaaagtaaagttttgtccgttttcaggggaacagctttttttttttttttgaggcagaatttccatcttgtcacccagtctagagtgcagtggtgcaatctcggctcattgcagcctccgcttcccgggttcaagagattctcctgcctcagcttgccaagtagctgggattacaagcgcccaccaccacgcctggctaattttttatatttttagtagagacggggtttcaccatgttgggcaggctggtctcgaactcctgacctcaggtgatctgcctgccttggcctcccaaagtgctgggattacaggtgtgagctaccgtgcccaacccagctttggttatttttgttgacctactctattgtttttctcttctctatttcacttatttctacactggtctttattattttcttccttatgcttgctttggacttagttcttctttttctagtctcttaaggtggataattaagttcctgatttgaattcttacttctttgtaaggtggtcatgtactgctatgaatttccttctcagaaatgtatatgctttcactgcatcccttaagatttggtatgttgtatttttgttttcatttgtctcaaggtatagtcttctgatttccattgtgatttcttccccctctaacccgtttattatttaggaacttgttgatttccacatacctgtgaactttccagatttccttctttgttaattctcagtgtcattccattctggtccgagaacatactttgtatgatttctatcttttaaaatttatttggcttgtcttatgacctaatacattgtctatcctggaggatgtttcatgtacacttgagaagaatgtgtattctgcttttgttgggtagagtgtttgacaggtgtgttggtacatagttctgttcaaatctgtttccttgcagatttctatctagttgttctgtctattggaagtaggatattgaaatctccaactaatattgctgaattgtttattgttttcttcagttctgtcactttttgctttatatattttgaaattctattgttaggtacaagtaagtttatgattattatatcttcttgatagattgattcttttatcattatacagtgccctataagaacaatttttatcttaagtctattggtctatattagtatagccacttcagctttcttttgtttactgtttgcatggaatattttcttcttttactttctatttgtgttcttgagtctaaggtgaatctctgtagatagcaattggatctgccaatctttgctttttatttggggagtttaaaccattgacatttaatgtaattattgatgaggaagattacttctgatattttgccatttgtttcctttattttgtgtctcttgttcttaaattcttccattactaccttctttcttttgtattacatattttctagtgtaacgattttaatttctttgtcatttcttttgttgtatgtttttagttattttcttagtggttgccacggagattttattgtcattttaacagcctaggttgggcacagtggctcatgcctgtaatcccagcactttgggagactgaggcaggaggatagcttgagtccaggagttcaagaccagcctgggcaacttactgagatactgtctctacaaaaaaatacaaaaattagccaggcatggtggtgtgtgcctgtagtcccagatgcttgagaggctgagttgggaggatagcttgagcccaggaggttgaggctgcagtgaactttgatcacaccactgcactccagcctgggtaccagggcaaaactagcccaaagaaatgaaggaaaaaaaaaatctaatttagattaatatcaactcaacttcaacagtgtataaaaactttgcctctgtatacctcttctgcttccactctgtgctgttattgtcatagattttcatctttctacactgtgtgtttatcaatgtagatttaaaaatattgcttagtagttgtctttagaatccgatacggagaaaaggagatataaacaaaagatgcatttttactgtcttgtatgtttacttatgtaattccctttcctgatgttgtatttctaaaggcaaagtagggttattgtgagtgtccttttgtttcaacctgaaagactccttttagcatgtgttggagatatgctaatgatggactctcacagtttttgttatctgggaatgtgttaatttatccttcatttttgaaggatagtgttggcaggatacagaattcttggttgacatgtaattctttcagcattatgaatatgtcatcgtactgtcttctgacctccatggtttctgataaggaatcaactgttaatcttattgaggatcacttgtttgtaatgacttgcttgtcgtgctgctttcaagattcattctttgcctttagcttttggtagtttgattgtgatgcatttaggtgtgtactttattagtctgttctacttggagtttgttgagctttgtagatgtatttcatcagatgtgtcaagttcttttgccactattttttttttaaataatctttttgcccctttccgctccttctgtcactctgattatttgtgtgttgctttgtttggtggtgtcccagaagtctctgagactctgtccagttttttcctccccattcttttttctttcacttcctcagactggatgatctcaatttgacctatcttcgagttcatggattttctcttctccaagtgacatctgtgagatgaatttttttctagagaatttttcatttcagttattctacttcaaaatttctctttggttcagttttatcattgctatctttatattattctcagtttaatgagatactgttttatactttcctttagttctttagacatagtttatgtcactgaatatatttaaaatagctgattttaagtcttttttttttatttttttggagatggagtctcgctctgtcacccaggctggagtgcagtggcacgatctcagctcactgcaagctccacctcctgggttcacgcaatgattttaagtctttgtctatgaagtctagtatctgggcttcctcaggcatagtttctgttttctttctttcttttcctgtgtacttcgtttctttgtataccttgtaattgttgttgttaactggacattttgaatattatagtgtaacaactctggcagtcagactgtctcccctccccagtatttgttgttggtgagtattgtagatgtttgtttagtgacttttcatggctaattctgtaaattttatattctttgaagattgtgggcaccctgaagtctctgtttgttagtttagtggtcacctaataattaacagagatttcattaaatgcctagaagcaaaatatcttccagtctttgcccatggcctctgtgtatgcattagggcaggccttgaactcttacccagggagtttacaaccctgccttagcctttactaccagcttctgcagagcattaaggtcaacaggtggtgagagtttggagcctactccatctttcctgagcgtatacacagccctactcatgcatgtggccctctagatttccaggaatatgttggaccctttcaaagcccttacagactccccagcttttcctctcaatctttagactagtgtgttgttttcttcaacagttatctgtcaggcagcagcaaattaagagattagcataaatgttttcaactcctccacccgtcatgtgccccagggaagcactaagccagttctaagttaggcaaaataaagacaatccttttgaggtggtcttccatggagtcaccagacaggtaaaccaaataattaattacaagtctttggctggatacagtggctcacacctgtaatcccggcactttgggaggctgaggcaggtggatcacaaggtcaggagattgagaccatcctggctaacacggtgaaaccctgtctctactaaaaaatacgaaaaaataggtggctgtggtggcgggcgcctgtagtcccagctactcgggaggctgaggcaggagaatggaatgaacccaggaggtggagcttgccgtgagccgagatcacactactgcactccagcctgggtgacagagcaagactccgtctcaacaaaaaaaaaaaaaaacaagtcttcatgaaagaggtccattctgctgtctttcataccaggaatgtggaatgtggactgttattttcatggctactgctaagctaggaatcaagggatagatggggactgggtaaaacaccacagagtttgctgttcttaccaagaataagctggggaagagggttgtttttgtttttcagtaaaaattccctgggctgcttcaagccgttgattaattttcaggttccgaaaaagttcagtttgacagtttttgccctttttatttgcttttatggatatgtagaacttgagttcttttttccaccagttttgctgacattgttttaaaagcactttttgtaaaacccaaatgttgtctctctcaaggctagccaataattaaaaatactgttactcccctttgattttggaaatgaattcgtattgaccaaaattcaatactagaggtctttcaagctgttttaccatttatctaaactttagaatctaatgattcctgtacattgtctagcatactggtggtcctcaattgtcataagttcaactttggaacaaatgaactttttgtgtgcaagtttccaattgtttggaaattacattgatgccccctccatcaaactgttattcgtgggacatctaggaatttcttacagcagctgacaaatatttcaagtcagtgcctggtagtactgtccaccaggcaacagcttcagtagtagagcgatctttatctataaggcagtgtttgagcaattgtttattagtgttttcctaactactcagaagaactatcaggggttatagaggtagctcagagagttgggtgcaagtagagaaatccacccggcttgcattacacatcttatttctagagaagctttcctttgaagaaagagttctaaggtttaaaaaattaccttgaatgccacttatattgcattttaattttattttagagaaatcaatggaaagtagaaaaattaaggcactgatactagtgttaagaatgttggttaaagcttctggcaattaattttttatttccttttttaattttattaaaatttaacaattttcagtttatgctgtaatccagaccaaggtttcaatctaatgaagttaatgccagtgttgctgctacctattttgtctttagtcattcagccatgcttcctacttatactgaataagctagcttaatctaacaatcaaaaaagaaagctgttgcctaagttaagaaaaacagtttgaactgttttcaaactaaatacccagtagactctctagttgttgacaggagaatgcttaattcagaattgtcctgcagtagatcattttatctcattcctgttcttctataggatagcttatttgtttgaaattgtatttaatatgttgtgatttttgtgtgcttgtttctatttttcactggatagactcaagataaaacctggtaccctgcagtgtagctatcagtttatagcagaggaaatttacattagaacttggctgtgtatttacatgtatctaacttggaggtcactctgcttactgttgatatatcagtcatattagatgagtccctaatgagataccagaaaccccggaaacatcattaggtggaacagtgtccttaatgctttattaagtgttataggtaagacaaagcctagtactatttgtggcatcaaggttaggtgtttaaagacctgtattcttctattgtcatgttgaaattgttcccttgatgtagcaatagaaaattttagattaggcttaagttaatcagcaaacaaagataaaagtctgatactatcctaaatattttgtgtttctaaataatttaacagtgatccaattagctactcctgtagaaatgtaattgataaacttttcactctcttttaaattgccatcttgaattttacctgttttttaaagctgtctcaagtcctctctaaaaaaaggcagtcatttataaatttagaaaagcttgatagcacagaaagtcacagaaaaatgtaaacatagtttaaaactgaattgtatacaagccactagaagtacttttattaagtttacaaatattagtagagtggaactcatgcatttaatatgtttgaaacttttgatcaaatactgtgctatgaaaaacattttagataattattctttaatcatgtgtgtgtaaaatgtggctttttttgacaaccaagtagcttttctgtgtgccaaactgtgactttaaaattttaaagtactcaacagagtaaacaaaccacaaataccacttaaactgtacacatttgcacatgcatttcctataaatagtacatgggtttcaagtcttcacttttgaaattcagaaatgggttttttctccttccagtagaaataaaaacttgatttattttatttatttatttattttatttttgagacggagtctcgttctgtggcccaggctatggtgcaggagggtgatctcagctcactgcaacctctgcctcctgggttcaagtgattctcctgcctcagcctgccgagtagctgggattacaggtgcctgccaccatgcccagctaatttttgtatttttagtagagatggggtttctccatgttgggcaggctggtctcgaactcctggcctcaggtgatctgtctgtctcagccttccaaagtgctggggattacaggtgtgagccaccgcatccagctaaaaacttgatttttaaaaatccaaatcgaagacagaattgtgtattttagtacatttattagcagccttgacgctataccatatggctgtttatcatttaaacagcttgtaaaagcaaacacttcaggattcatgagtggcagaaggactgagtactttgggaaataagagagaacttttgttgaggatggttgaggaagagtccaagacaataataggcagaataagcaaaaatctagagactcattgtaggcactcaagtatgtatttgttagaatgaatggctgaacttggtatattgaggaacactgagaaagccatactgactggaagatagttcctacaagaaactggtgagacatatgttacagtctagattttggtgagccttgttaaagtttgggctttatttttatacggggagaaagtttcacaggggtttggaaatgaggcttggagctgttaatggggacacagtgaggttttagggtagtggctttcaaactgtttaaatccaaactttgatgataaccctgacataactattgtttataacttccatttcagttgtattggttttatcaaaacatcttcattgatcttactgattgcttcctatgcagattaatattataaatttgaatgtacaaaggaagctttagcagtaaaatagcaacttttatctgtcttacgtattggaggttctgcataagatttaattttttttttttttgaaatggagttttgctcttgttcacggggctggagtgcaatggtgtgatctcggctcaccacaacctctgcctcccgggtttaagtgattctcctggctcagcctcccaagtagctgggattacaggcatgtgccaccatgcccggctaattttgaattttagtagagacggggtttctccatgttggtcaggctggtctcgaactcctgacctcaggtgatccgcctgcctcagcctcccaaagtgctgggattacaggcgtgagccaccgcgcccggccaagatttaattttttaaaagaaaatattttgctaagggtttggaaactcttgttttagcaagaatggattaagactgattaaaactaaaggcaaagaggaggctcttatgtttggaattctttgctaatatttacacaatataattctctccacaaatatttaatggtaccagatattagatggttataatggcaaaagtgttcaaaggatgctatcatattcatgattcatgatcaaaatgaacattataaggctatccctcttcagaattaaatacgttactcctgtggaaaacttgcttttaatgtagaagttgtcccagagcctttcttcctttctcatgtcctcttatgtccactgctgagctaacatgggtctcactgaatgattaagaaaaaacatcttaggtggggagttctgtatatagtaaatgtttaatttattggggtggtgaacgggaagtgctgctggcaagagaggatgggaagagaaatctacccaaatccttacccgctttacagaacataaacttcctattcagtagtacacaataacttaacgatcaaggcatcttaacttttctgttttcagatgaaagaactatcgtttggcttgatcaagtatttagtatttattcgttcactcaagtgcttacgtttttttgttatctcagggttttacgttagttattaaccaaaagaactagttttagttctggaagtctaaaatatataagagaaggtgaggagtaataagagaagatgaagggagactttcggaatggcctatgaacttctagtaactataccaccttaaaatagacaaattacaatgcagttatgaagatatgtatttttcagtgaagacaactaaaatgtttgcacagaattttcttttttattgagtgttagaaattctattttggagatactaccttgcacaacataaaaagaaaaagtgagtgtggaatctaggaatctacgtggctctaggaaattttttaagtgtggaaactgaaggagagcaagagaaagggagcatggcattcccctgtttgtagttcatgaggtgggtttaaattgccttttgccaatgcagctgcacactgaggattacagaattctttttaaatgtttgtagaattatttttcacttattaggtaaaacgtgtattttttgattttctccaatttcagctttctcatgttgctatgctcaattttgtataccatatatagttttgttaaattgacaaagtggtgttttttgttcttctttttcccattggttaaaatttaaagagaaagtggaagctagaaatttatctaaaaaatgtaactttccctgtaattattaaagtatcaaatctaaatttgaattttctttgtgcataatcttttttcaagctatttaccatgttgacaaacttgctttcctgtggcaaatacactagcaatacgttataaatatgtaactttcaacctatttacagttgatgcttttttagccctttggatttaaaatacaagcactgaagaggtgaggaagtaccactgctgcctcagcattatttcgaaattctgtttataaactatacaatttccaaggtcatgaatccagcacctttccaggtactaactattgggacaaagatagaatttgattttatttatttacctattgactgaagtctaacttaaatcttgcacctagtaagatcttagaaataacgtgtgtactctgacctgtaaactaatcctagtattctgtgtgtatattctttctcatttgggctcttaaaaggaaaagtaacgtacatctgatgatcattagcactgagctttttcagcaaaaagtatatgtttataaagaagtataggataatttagtaatttaataatgtgacaacatttgcgtgtgtttttttttttgagaaatacaaattgtgagaaacagaaaagtaaaagaagcagcagcagaaatatcactataggatcaaaagattgcaggaaccaaaactccaaaattattgggcataatgtactaaaaacagggcagtggaggaaagggacagtccagactagctctgagggtccaaagaaagtattaaatattgttactggagtgatttgctctgctatttgggcttgggaattaagtgaaattgttgatatactagacagatacttcccacccatttttctcttgataatcagggttcattttttctattttctatttctctggatgctccatttcttaatattaatattaatattaagctctcagtctttatgctaaaaattggttatttaaaacaatttaaatcaacttcagtctaattggcttaagttcaaatccattttaagatcgatattgtgtcctttaaaaattttatttaaaagatatttaaactgatgagaggatactacccattccactgataaactattactgtaagtttgtctattgagggctagttatttggtttaaaaatgctgagattatggaaagtggattggaatattttggagcaatattaaaaacagtatctgtaacaatttaataaacttataaattcctctttctctgttgatctatcttgaaaagacactctatgtctctaggcattccttctctgtggtgtgattggtagacagggagtaaacaacttactgtaaatgggcaccatgccagttggcttcaggcagcatcaagcttgtgactcacagtcagggttaggaaaatgccttttaacttgtttgtctctgcctcttttaaacattaaaggcacaactgtactaattattaagtatttcataaggtcttttagggcttataagatcttttaggaatggcctggaagttattagtactgtttcattgaatctgaatacctttaacatgataatgagaagtttttaaagggtggttttatagttaaacggaatttctcaaattggcttgctccttatgttgatttatttaggatcacatttgggagtttctctgccctactttcaatgtatttaatttactgaccatcactatttggggggaaaatgttatatgatatttagaaaccaagagttttggagtttttcccccattagatgtatttatttatttatttattattttttaaagacagggtcttgctctgtcacccaggctggagcacagtggcatgatcctagctcactgtattcttgaactcctgggctcagactgtcctcccacctcagcccaagtggctaagtatcaagtaagaatcacctggcaaattccaaggctgtataccagatttcctaaattagaattttggggttgggtatctgaattttagtaaagccctccaaatgtttctggtattgcttctaagaacaattgataacataatagctgtggccattataggggtattctgtcatatttagatataggcataccttgttttattgtacttcccaaatattgcgtgtttattttgttttgtttcacttacaaattgaaggtttgtggcaaccctatattaagcgagtctgtcagtgccatttttccaacagcttgtgctcattttgtgtctctgtgtcacattttggtaattctctcaatatatcaaactttttcatcatttttgtatctgttacgaccagtgatcagtgatctttgattttttctttttttttttttttttgagacggacttttgctctgtcacccaggctggagtgcagtggttcaatcttggctcacagcaacctctgcctcccaggttcaagcaatcctcctgcctcagcctccccagtagccgggcctacaggcgtgtgccaccacgcctggctaatttttgtatttttagtagagatggggattccccatgttggccaggctggtctcgaactcctgacctcaggtgatccgctcaccttggcctcccaaagtgctgggattaccgtgccagcctgatgttactattttaattgttttcaggcaccataaacctcacctgtataaggcaccgtacttaattggtaaatattgcgcatgatctgactgctcttccaactggccattccctgtctgtctccctcttcctgggactctcaaatccctgagagacaataatattaaaattaagctaattaataaccctacagtggcctctaagtgttgaagtgaaagagttgcatgtctctcactttaaataaaaagctagaagtggctaaacttagtgaggaaggcacatcaaaagccaagacaggccaaaagcaaggactcttgtactaaacagctaaattgtgaatgcaaaggaaaagctcttgaaggaaataactagtgctactccagcaaacatgtgaatgatcagaaagtgaaacagccttcttgctgatacgaagaaagttttagtggtctggacagaagatcaaaccattcacaacattcctttaagccaaagcttaactctcttcaattctatgaaggctgtgagaggtgagaaagctgcagaagaaaaattggaagctagcagaggtcggttgatgaggtttagggaaagaagccagcgctgtaacataaaagtgtaaggtgaagcagcaagtgctgatacagaaactgcagcaagttatgtagaagatctagctaagattactaaataatagattttccatgtagatgaaaaagccttttgttggaagaagatgccatctaggactttcatagctagaaaggagtcaatgtctggcttcagaggacaggctgacattcttgttaggggctaatgtagttggtgactttaagttgaagccaggtctcatttaccactccaaaaatccgaagacccttaagacttatgcttaatctactctgcttgtactctagaaatgaaacaacaaagcctggatgacagcacatctgtttatagtatgcttcactgaatattttaaggccactgtaaagacctgttcaactgctcagaaaaaaatgattactttcaaaatattgctgttcattgacagtgcacctgggctcacccaagagctctaatggaattgtacaacaagatggatgttgttctcatgcctgccaacacatcatccatttgtagcccatgaatcagggagtgatttcaagtttcaaatcagtacattttgtaaggctatagctgctatagacagtgattgctctggtggacctgggcaaagtaaatcaaaaaccttctgaaaaggattggccattctagatgctattaagaatttgtgattcgcaggaggaggtcaaaggatcaacattagtagcagtttgaaagaagttgattccaacagttatagatgaatttgaggggttcaacacttcagtttaggaagtcactgcagatgtggtagaaacagcaagagaactagaattagaagtggagcccgaaaatgtgacggaattgctgcaatctcatgagaaaacgtgaatggatgaggagttgcttcttatggacaaatgagcaaataaatttttttcttgagatggaatctactcctggtgaagattctgtgaaccttgttgaaataacaacaaaggatttagaatattacataaacttaattggtaaagcagcagcatggtttgagtggattcattccagttttgaaagagtttctactgtgggtaaaatgctatcaaacagcatctcgtgctacaaagaaatcttttatgaaaagaaaagtgaaacttcattgttgtctactttaagaaattgccacagccaccccaccttcagcaaccacctctctgatcagtcagcaggcatcaacactgaagcaagaccctccacaaggaaaaagattacaactcactgaaagttcaaatgattgttagcatttttaagcaatattttaagattaaggtaaatacatttttaaagacacaatgctattgcacacttaatagactacagtatagtataaatataacttttatatgtagtgggaaaccaaaaaattcgtctgacttgctttgttgcaatattcactttattgtggtctagaaccgaacctgaaatatctcagaggtatgcctgtattaatattattttgcaagtaaaaaacccagcatataaaaaaaacgtagaatatgttgagagttcagtaatatggatgaaaatgtttttctctaactgaagaacatgataaattataattagggaaggatataaaccaagaaaatatgtctgagatagccaattcttgcagttcataatatgaaaactcattataccaatctcagtaagaatacttttaatagctgttatttctttgggatatagaatttataaagtacacagtaatcttcttatgatcaatcctaggatcactttacaaccacttaccccatattacaatgtagtaccaagacaagcagaccaaattatagaaggacaaagtttttgctaagcatattttgtcatcagcataccgcattgtgtgtgcatgcatgtgtgtgtttgtgcatgtgtgtgattgtataaaatattagaaagccaccccagaaaagttaaatgactaggaatgttgtgaagggattaagctacccctaaaattatataacaaaactctcttcatctattattaggtcatctttagaacatcttctcttaaatttgttataggtctctctcatctgtttggattaaaattggtctgaaagcctaaaatggctttttacctatataattatttcccaactagcttgtagtataggtgcaaagctatcacacttgctaggttagtgaagtatgtaaaaactaccatctttcaattaggaaccatcggatagcttctacaggattgctggggagaacctttataaagaaagttatatctttataaattttttgtcattttacttagctgagaatataaaataagttagctaataatagagtagaaatgttttctgtaacagattaatattgatcaaatgtgttattaaatgctaaaacaccattttttttctctgtaagccatgtgtttcatgccacaacacaaaagggacaattgtctgtgttttatgacagttctgttctgtcagatgctgtttgttcattttggtgaataaatgaagagagccctggacacatctttttttcctcaacaaaagaggaaaattattcttgtctgtatgtctataatcctgactctttgaatggctttaatttttttaaagtcagcatttttttataaagataggtgtttggaatgtgggcgatatggctggacagttagattgggaccaaataatggaaggctttgaacatcatgctaagaggtttgggttttactctgaaggcagtagagaaccattatgtttttaagccaggattgacttgttctaagctgtaccttagaaatattactctggcagttgtacataggatgagctgtatgttgctttgttttgtttggggagacagttctcgaagagagactacatacgaaggcagttatatgagtcattactaaaggtctggcaagaagtagtaaaagcattaactggagtggtagcagtagggaaggaaataaaaggatagatgtgggagtcatttggaaagtatgaggcaattcattgaccttacagaatcactggttttctgcttccactccattcacattgacctttccaaggttatcagtgacctgcttgtccttaaattcagtgggcactttccagtaacctactgttggcaccagccctgtgctagacaccaggatcctgtttgtaaaggcatctgccagtggtttctgtgacacaattctgtttctagttttcctccttctacttctctagcctcttggcaagttcttctttcagagtttctcagagctttgtgctaggccctcttctcattttctccttctctaagtgatcccatccttttctgttgcttcagttaccatttgtccttatgcaaaggacagccatatctactgtatctccagctcagatgtatctctttgcctcctgacccatatttccaactatctaactgggtatcttttcttggatgagttataggtctctcaaacacaacatgtccagaataattcattgacttattctaaggcctgcttcctctttctcctgtagtccctatctcaggaaatatatggtgctatcaaccccaaagcagaaatctggacataatccctaactacccttttcccctctctgtgcacataatttcagtcattaggcctcatagattggactaaataaatacctcgcaaacccttctacttatattcttaactgctcctaccttaagccaggctaccataattttgtagctggatgactgcatcatcatcttgactggctcccttgtcatcttcaatctatattctatactgcagctagagctttcaaacataaacatgtgatcagattagtcccctctttagaacaccctagggttctcactgtcctgagtacagtctaagggtttaccatggcttacagggtcttttatgatttggtgagctttttattgtataacctttctaaactgcctttacttccctctttcttggctctgtgtctttgcataatgctgttccctatacttcacctcacgtctaaccttcatctccttttcacttctcctcttcctccaaaatccagctgaatatcacattgtcatgcaggcccattcttgatctcccacgtttgggttagatatccctcttcagtaccatcaccgcaccaggtgtgtcccctatcctagcatttgcctcattgtattacaactactgtgtactcgtctctacagctcctgctagtctaaaagttttgggagagcaaaggttcatgtttgtgtttttcactgtggtataccccagtgcctagtatatgataagctctcaaaatatttgttagatgtatgaagaaatgagaaagagaacaggaagagggtaagtttcaagactaggaaacaaggctatgaaagctgcaggaaagcagcaggttaaaacctagaagaagagtttgttttaggaaatactgtgttttaaaccactataactgaagcaaaaacccaaggcctgggtgtggatagagtccactatctgataacagtggatactgatgcatggcagagttggagaggaagagagccagattccaaaacagaaggggtaaagtcttctaagaagatagattatagtaagaaggattaggggatagaaatatgagcctgttccactcatagatctcaaacatgaaatgatgagtcatcatgaagagagtaggcaattgtccagtgaagaaggggatgctaacccttcttaaccttgaatctctcaggtagaagcagttagagaaggaacagccatcatcagatagtgttgtaaggaaaatgatatccttggggaaacctgcattttggtaaagcaaagcaactaagaaagaatatactaccactgtttaacaatcgccacaaaaagacagtaggatcatctttgacccccctcatcctttctcaggaacttggaggactaagaagagagaaatctgtagaagaggcttctctctctgatcctccctccacttcagttttaccacatgtaatgcaacaataattaagaatttgtgtaaaatttcaccaggttggcatgcatggagagaaaaattattcagatgttttcctttgtcaataatacaaggagcatttgtagggaaaaatatttacaaatacagtaagacctattctctttctatatttatgggaaaattttaagttgtgcccttgtttcatgtgtgtttctatttaaagataccatacttaatatatattgttgattcattaacattgaactcatggctaacagcactataaatcatgtctgatcaaaacttatgatacatgtactttcttcgtaaggtacatcatagtcttctcgtacatgggaactctaggtagtacttcaggactatgcatagaggccattttaaacagcaaaattcccaacaaaaagcacaaaactcaaaaaatgtgccactaaatttaccatgaaaaggacacttgtttacagtttgagagctaaaacaagaaggtggcgtgtcacttcgtttgacttcagctgggaacatgcatatcagtcgactcaaattttttgctattctgtgcttatccacgaatcgataggaaagcaagtgtggatttgggggttacaaataaaatgtagcaaatgtgtaaacttgcagatgtggaatctacaagtagttagaatcaactatgttagtctgatcattaaatcagttttttaaagtactattgtaacaccttataacctgccccattcactgagtgttgtagtttatagtttcattgggcattttcagtagttttatctgaagtcacatttcaaattttgtaattgaagctccaaagtatgctaccggaaacacgagctgatgctgtgagacaaaatcaacaggtaatccaccatcacaactgtgggctagaatgctcaagaaaccttggaggcccagagagctgagatgaatactgaagaatcataggcaggtttactctgtcaagctgcctgtattttgagggtgtagtcctcaaaccaaaaagacaccaaatgaacaaactcagatggcctcactggggaacagagattgaaagctgacactggaatgtgtacttaaaaaaatgagagcccgttttggaaaggcagactgggcacagaatgtggagagctatatttgctaactgaagaaatttagactttatcctctacaaaacaaagctattggtttttgaaggttgcataaaagctgcattttagcagcatatattttggtagagctgttacctgcctgaaaacatcaatgtcatttcacacaaatgatacttatcccttggtgtttgatctaaatttctacaatgagaatgtgattttatagtctttactggggaaggaagtaggtttttcaggccgaaattcttgtgtagcaaaaattaacacttaagttagcccttggcaatctccagttctataatggtaaaatggatttcccagaaagtcactctctatccctttgaatagacattagaaataacatgtactttaagtgggatttacagaggaagggggcctttaattctttactagtgtgatgccctgtaaaaaaataactaacattagagttgaggcctagaaatagcagcactgggttaaagtctgttttcaagtgcaagtttttctttttattcgtgtgtgtgtgtgtctgtgtgtgtttcacatagaaggaggaaatgccaatttcagttcttacaaatattaatgactgcaacttataaaaatgttacagactatattcttcccttttgtaacagatgagaagattttgaaatttagtctctactttttagtttggtaagacaatttgaataaactgcaataattgcaaaagaattctgaatatttgaacatttgacattttctatgtcaaatatacatttcttgtactatataaacattctagaaaagagagacaggcagggaggaaagtgctcattaaaaagagcttcaccctctctgaaaagggatttcctttacagtgctgtgtactaaagcctgtgttgtaaatcagaaagcactgagcacacatgttgctgctttggtagcatcagaagtcgattttcattagccttataccattcactatttctgccaagcaatcttaaattataaaagaatcttatttgattttgtgattctcttgttttctgctcataaagaaaatatcctaaattgaacaatggcatgctacgtttttagtttttaagacagctaatgtgtaaaaagacatttaaagtatagttgtgttaagtttttgaagtttacagttgtttcaattttgctgctatactttgttaacatattttaggaatatttcattttagtcacaactaggatataaacattattttggtggcgatctccttgtaatcacgacatcaaccaaatttgggaaattttgatttgttagatttataaattttacagtaacacaaaagtctaatttcctatatattttcaaggcccctatacctttgtcaaaataaagtatcaatgaaaaatgaaaaaatcataaactatgttcaggccaaactgatactgactttgttaaaaggctagatagaaatctgttttcctcttctgttacatctcctcttctggagaccactctgtgtggactgaaggtttgagatcctaggacctaggctagaacagattaggagattgtgctgtatgttaagtggcagataccatggaattctaagcctgttacgaaggaggagaagaagaggcacaatgaccctgacacagcccctgggttgaccacagcagatatctcacttgagcaagtagatatcatctcaattgcttgctgattatctctaacttgtcagtaacttactttgataacctagatttaggagtctgacagcatgcagtgtatgcctcataataatctgctgtttatgaaagtcataacattgtatgtttagcataatggtgaagagcctgccatctggaatggtctacttatttgggatccacatacagtaagctctcacttaacatcatcagtaggttcttggaaactgtgaccttaagcaaaacaacctctaatgaaaccaattttaccacaggctaattgatataaacaagagttaagttcctgtggcatatttctggtcacaaaaacatcactaaacttctaaataaagacccaaaacacttataatattaaccactgaaataaatgtgagctatatatatacatttaagaataataaaaacaaaaaataattatttacccaatttttggtgaaccagtgagtgatagtgatcatagtgatggtggatgaaatcaaggaataaatatttgcaaagtgaaaattgtaagaagcaccccctgtcaccacatagctcagaaataataattagggcaggcttgctgagcatttttaaactgcactgtttattgtcatgcatttgaatgattatcgcagactttatgaattttcattttataataatttgtaggccaggcacagtggctcacgtctgtaatcccggcactttgggaggccaaggcaggcgggtcactggaggtcaggagttcaacaccagcctgaccaacatggggaatccccatctctactaaaaatacaaaaattagccaggtgtggtggtacacacctgtaatcccagctatttgggaggctgaggcaggagaattgcttgaacctgggaggtggaggttgcagtaagccgagattgtgcccctgcactccggcctggtgacagagctagactctgtctcaaaaaacaataataataatttgtattcattcattttccaatgtgttcattccagttcagggtccagggggcctgcagcttatactcatagctcagagcaactgaccctatagacaggacgccaccccattgtagggtgcactcaaatgcacactcacactcaaactgggacccttcagacatgccagttaccgtatcacacacagcttcgggatgtgggaggaaagcgaagtatctggagaaaaactacacagacatgggaagaacgagccaactctacacagacagtggccctggacagagctgggcaggcatcagttttttttcttttttttgtggggggtgagggtggggcatggagtcttactctgtcacccaggctggattgcagtgcagtggtgtgatctcagctcactacaacctccacctcccgggttcaagagtttctcctgcctcagcctcccaagtagctgggattacaggcgcccgccaccacacctggctaatttttgtatttttagtagagacaaggtttcaccatgttggccaagctggtctggaactcctgacctcaggtgatccacccgccttggcctcccaaagtgatgggattacaggcgtgagctaccgcgcccagtcagcatcattttttttttctcatcaacgttaaaacaatgttgaacaaaacattattcaaagacctgccgtatggctattttctagttgtgtgactttctttgggaaagttagcaaccctttctgagcttaaatgtcctcattcataaaatggggctagtaataatgcataaggtttttgtaagaattagaattaataaagtacttagaccataataactaattagtattagttgttgtctttgctattattttgatgtggtggttgtttggtttcacctgtgtactatcaggacatgctgaaataaaatttaagaattggctttataatattagaaaagcaaacttttgtacgatatgggtatgaaaaattgttgggagtctactttttctctcttacctaatttgtcttagtctttttaaagcttagattttccaaatgagccatagcaaaatataatgtttaaaaatgtttaaattctaagcactatgtcatagttaaataacttaaaggtgctacatcttatacagtccaaaaggaacataattagtaaaattctacaatttagaaaaaaaaatagctgacagtgactgatttataaaagtaaaatatcttttgttaatactaatattctttttataaattaattgatgacaaaaaattgagtgaatgagatttgcagttcatttatctatgatgctggtttatttaatctctataatttgctgtatttgaaagagcatagtgatagaggtcatgataaaatctaggcccagtgccacaagtaaatccctgtaggaactctcaaggttttgatttcatctctgaatgggaataacaccttccaagaatattatgaagattaaaaagttacgtatcataaatacacacagagtaacaatactgggaatattgcaacttgtaagaaagaggaagcatatggcatattctgatggttagggatatggactctgtagctgggatgcctgaaagagaactctgactccactaatggctagttatatgaaattgtgcagataatttaacttctctgagtttgcatttttctttgtctatataatggggataataatagtacctacctcacacatagtgttaatttctattagtggttctcattaagatagtattgttgttcatccctggttgttagccatcatgtatctgagttagagagtcattgattttagaaagtcccgaggagactatcaggtcaagcaacctgcctcctgctagacaattagctttatccatgagttaccaaagagggagccgaaacccagggaagctgaaagagctgttgattgtcaccctgtgagttggtgatagaaagatatctggaatcccagtagttgcccatttcctagttctgggctctgcattgcactagaatactgtgccattctaaatatgaaaaggcagtatgaccattgtgcttgtcactttccattccctagatgctatcttatatttgtccttatgaaatttaacctgtgactttcagatcacttagaaccttggttggacagtgttttctagtgttatttagtatatttttttgtcatcttctgttgtctttgggttcccctaaaagagctatactctgggtgccaggaaacttcacacatgactgtcttctcttcctcgacttccctctctacttacctttccagctcgtagcaaatcagaagacttctctgacacctctctatgtctaaaggtcctttgatattctcacatggcggcatgaatcacagtgtattttaactggccttttccttgtgtgtctcctacaatgagctgttgaagcttcatgaaaacacaatctgttttactcagggcagttataattccaattacaaagcacatttcctggctcctggctaggaactcgatcatttttcgatgcttccttgctcaggactttctgattccttcttaaaacattttggggcatctccttctcctggtttttggaaacatattctcatactgctatgaaggtttttactgacatttccaacttctcttaaattgattcagcaaatgtttttccataataaatgtcattgatatgtcatcaatatggagagcaacaacagaatgcattgagtaaactcctcccctggaggtctgagaatctagattccagttctcacagagccaccaccttggtgaccttggacagtagaccttctaagcctcagtttccttatcccttaagtggggatattaatagaacccattctcagagatgttgccaagattaaaataaccaagataattcctgtagatgatttggcatagtgcctgccacgtactaagcaagagttagcctccgtcattatagtatgatcataaaaaatgaacagactaaacgaagtaaccagaaggaaagaaattttaattcttaaaatgtaatagtttcttggtttttttttttctgtgaaacacctgcatggcacctttttgttattcatactgttttgactgtggctgtcgtagattcttgttgaaagtctgagagactgagacttgtcattttgaacatggcatcagtggaacagcttatgattcaataattgcatcatcctggacaagcaccagtagaagtgagtcaggacatgtgataaaaagacattcattttgcccctcctccctctctgtattttctttgctataaaattattgatgttaagcccatagtactaatatttcagttcaattcataataaaatttgagggcatttgaatatattatctgttgtaaattataattttatatttgaccacagagtatttgaagtgggtcttttctttccccaaaattctattttaataactaaaaaatattcttaggagaagtattatttaagaacaggtttatattaaataacatcatttcactttcaactttctggtggtcaaaaaatatgctaatactaattaggatatgatacacatgttctgttagaacagttttggcagttagaagacttctcttcttgtgtttgaaagggatgttacttggggtagttatgagccatgtatccagatgtcctgaaaggaccagtggtagatgtatttctatttttgtcttttcttttttctttctggcattctagttgctgagtgactgacttttgttttcagctcttctcacaatcaccattgttctaataactttgcttaaatagaatgtctccttttgctataagccatggggccatttaccgttaattttttaaagtactgaaatgagaacctcataaattaaagaacactcctgattctgagttagcagatcctactaagccttttgcagatggaaatttcctttaaattggtttgttttcctttaacattccattatcctattgttcattctttggagctgtgatttgtttaatatatttcaggcttcttaataaatcaagtcatgtaagttattatttggatcatttcgaaactacaacagcttatcaaacctctgaaagaagaattttgtgtttgcccacagactgaagaactgattcagttttattggctgagctaccttcattattcatatttaattcctggtactgagggtgggaggagggagaggagcagaaaagatacaactattgggtactgggcctaatatctgggtgatgaaataatatgtacaacaagcccccgtgacatgtgtttacctatttaacgaaccctcacatgtatccccaagcctaaaagtttaaaaatatatatttggtaaatcaattgatgtgttttaaaaaatatcgccttttggccgggtgtggtggcccatgtctgtaaccccagcactttgggaggccaagccgggcggatcacgaggtcaggagttcaagaccagcctggccaacatggtgaaaccctgtctctactaaaaatacaaaaaatagctgggcgtggtggcgcgcacctgtaatcccagctactcgggaggctgaggcaggggaatctcttcaacccaggaggcggaggttgcagtgagccaagattgtgccattggactccagcctgggcgacagagcgagactctgtctcaaaaaaaaaaaaaaaaaaaaaaatcatctttaaagagataactaacccttccccagaaggcagggccaaagtctaaggttcttccaggtcctttgtattccctataaattttagagtcagcctgtcaatttctatacacacacaaaaaaaagcctgctgggattatgattggtattgcattgaaattaaatcaatttgggtataagagacttcaatttggggattgagtctatattgagtcttccaatccaggaacactgtatatctctccatttagtcagatatttagtttatttcaacaatattttcagatctttagttcctttcagcaatattttctcatttttcctgtaaagctcttgcacatcttttgtcccatatctattgtgtatatgtgttttgctagttattaaattatattaatataaattttattttccaattgtttgtcgcatatatagaatgttttaaaaatattgtgtcctgtgaccatgctaaattaactaattctagtcattatgtcttcattatctttctcttgaattttcattgtcttccccttctgggactccattcatatgtaaggccatttgatactgtctctcaggtccatgaagttctgttaatttttcttcattcttctttttctctgtgttcttcaactgaatgaatgccattaataatttggtatgtaatggctcacttaaacttccttttgtttttaagatatttctactctcagctgtgtctggaatcctttagtccggagccccaccaaccctcagcctagaaggaaggaggagaaggatagggtgaaaggaaggggagagcttctagcttcaggacagagatcagaacaaacaacagagcagtcatcttggataaggaaacttccctcaaacctattacttatatcctcagaaataagaaaaataatgcatttatcaaattaaaggattttgaaaaagggaacattcagagaataaaactaaactcttgaaagttaaaaggatgataacataaatgaaaagctcagttgaaggattgaaagataaaagtaagaaaatatcccagaaataagagcaaaaagacagcaatgtaaaataggggagaagataagagaattagagaaccagcttaggagttctagaaagagaaaatgtagacaacaaaaggtaagaaatcatcaaagactggagtaggggaggtcatgctatctgtttctttttctattttttattttgagttacattttttttactgtgaaacaagcatatgtacatgagaatgaacaaaacaaatatgcagtcatgtattgcttaacaacagagataggttctgagaaatgcatcattaggcgatgtcatcattgtgcagacatcatagagtgaacttacacaaatctgaatggtatgtcctacagtacacctggaccatatggtatagctgttgcttccaggccacaaacttacagcatgttactgtactgaacactgcaggcacctctaatacatcggtaagtatttatgtatctaaacatagaaaaggtacaataaaaatacaatataaaagaggaaaaaaatagtacacctgtataggtgcttactgtgaatagggcttccaggattggaagttgctgtgagtcattgagtagtgagtgaatgtgaaggcctaggacatttattatatgaagtctactgtagtgtaaactctgtagacttaggctacactaaatttatagaaaaattttcttcaataataaattaaccttagcctactgtaacttttttactttgtaaacttttaatttttttaacattttgactcctttttagtaacacttagcttaaaacacacacattgtacagctgtaaagaaaattttatgtccttcttctgtaagcttttttccatttttaagatgtttttatttttaaaactgttactaaaaactaatacacaaacacacacattaacctaggcctatacaaagtcagtgtcatcagtgttcaaccttcacatgttatcccactggaaggccttcaggggcaataacaaacacagagctgtcgttttctgtgataacagtgcctttttctgatatacctactgaaagacctggctgagagtgtttgacagttaacaaaaaaaaaaaaaggacaagaagtacactctaaaataatgaaaaaagtataatacagtaaatacataaaccaccaacatagtcatttattatcattatcgagtattatgtactgtacacagttgtatttgctgtacttttctataactggtagcacggtaggtttgtttataccagcatcaccacaaacataagcatggtgttgtattacaatgcacagctgcagctaagtgataggactttttcagctccattataattttatgggaccatcactataaatgctgtccatcattgactgaaatttatgtcgtgcatgaccatacatacaatttaatgaaaaataataataataaagctagcagtgtgtaattaccaaccagggcaagaaatagaatattgccaataccttggaggcctccagtatgaccatataagtttacaaatcctattttgttcctcctccccagaggtaaccactgccctgacaaatgtgatcgttgttttcttgtttttcttactacctatataaacatccttaaacaatataactcagtttgtatattttgaattccatgttaatagaatatcatatgtatatgaattttatgtgaatagaatattatatatgtcattttgcatcttgcttttttcattcaacattgtaggattcattcatgttgtagtgtacagctgtcgtttattcattgctgtatagaattatatcctcagagataagatatatggatgtttataaatcattccactattatgaacatttgactagtttgtagtttttatttaaccaaaaaaatgctgctgccaacattcttacacattttactgtatatgcacattaatttatttacaagtataaatttctttttgaatacatatctattgatggagttgctacatcataggacattcttgtctttgactttactggataataccaaactgtcttccaaaatgattacatccttaaactcaggacacatcttattgtcaaatgtttaatttttgtcagtctgatgggtatgtaagttattttattgtcgttttaatttgcatttccctgattactaattaagctgagtaacttttcatatgtttattggccatttggagttcctgtattgtaaagtataagtttttttgtccatttttctagttttctgtccttttagttgaaatccaaatttgcctaaatctgttattctctgagcacaagtaacttgggatgctttcctttagatttagcctaattctttatcattttgtcagcttgatggtgcttttaaggagatatatatgtgtgtgtgcgcacacatgtgcgtgtgtgtatatatatatatgtatatgtatgtatgtattttttgagacagggtctcactctgtcacccaggctggagtgcagcggcacagtcttggctcactgcagcctccacctcctgggttcaagcttttccctgtctcagcaacccgagtagctaggattacaggtatgccaccatacccgctaatttttgtatttaatagaaacagggtttcgccatgttgacaggctggacttgaactcctcacttgaactcctcacgtcaagtgatctgcctgctttagcctcccaaagtgctgggattacaggcatgagctaccgcgcctggcctggatattttttaaaaatattttttatctagcactttggtttttggcaggcaggttggcactcatagtctgacctaccatttctataaaaagaaacctgtaaatgttcttaaacagactttgaaccagtcttcctgattttgaacccctacctttacccccagtttttgagcctttcagaattttttttcataataattaggttgcttcttagctttccccactggtgacttaacagatcttaggaagccaacaatccttgtccatctgctttctgtcttgtgaactgttgctggtattgtctcttctctttattcttagaggtgtatgcttttaaaaacatatactgggtttgagagggagctgaaataaaagcatgtgttaaatataccatctttaaccagaactacatttgactggtcattttattttcaagctcacatacacttcaaacagagatatggctaaaggaattatcatgtgaacaacagccagggctctgaacatcacagattatatcatcatacttgaaatatttgaaattttgattcaaaatgagagctttatagctatgtcctcaatggactaagtgtttaagtacttaacatccaaaacattcttactaatcaagagaagacaaacaccccaacagagaaataggcaaattttatcaatagccagttcaccagatttgttttctgttagaagcgaatatggggaaatacatgtgtccatgttttgcctacttttcctggagcaggtaaggagaggcagtttaaggatccatgtgataaaccctaaagttgtccatcggctttccagtcccttctaggaatttaacttagggaaataatcagacatttgcaaaggtgtgtacagtggtatttataatagtgaaaaaccaaagaatgaccaataacgggagaatggaagttacagccaaatactttacaactactaaagaatcatgtaaaatatctattgacataggagttttatcaaaatgtgaagtatacagatgaatagtaccacacataaaaagcaaggtgcaaattagccatttatattgttatccccaaaataaatagatgcagtttttttaaaagatgcaggctatatatggaagtgtttgctggttttctgtcaaaagaatggcgactttattttctaatttaaactttttgctgttttctaaattgtctaaatagttatagtttttataatgtaaaagtatcttccaatttagcttcatttgacaaattaccttttcattctatctagctatgtaattctaaatgaatttacagcagtaatcttagagcagatgaatttacaacaataatcttagagtagactacggattagatgtaaaaacatgagttgggctttatggttacagagagttttcctcagtgtggggatcatagctgtattgagtttattcagttttcctttcccacatgaatgaaaaatggggccagcctacaactggaagggcctcggcatgtaccactgtactgtgtatgatgtgatttcttgatgctagtagggagagaatcaaattgcctcctattcaaaccaagacccacaaatagcgtcaaccagtcatttcagctactccctgcagtgtcaagaaggtgtgaacccctcatgttctctattgcatacccttgtctaattcagtgtttcttcttcttttcaggttttggctttatgctacatttcagaaatcataataaccttttctggtattattttattctttttcgcactgtgagaaaaattaaactttcaagtggatgcttcttataaactatttatacccttttgctcccttttgggaggcagggacagggacagagttcctcctcaggctaactaagaaaacttactgcttccaatgtaatttaaaagatctccctctttctattgctctctgtactcttaattcttttttttttttttcacagcagagacaagtgaacatttatttttatgcctttcttcctatgtgtatttcaagtctttatcaaaacaaggccccaggactctccagattcaattatgtccttgggcttggtcgactgctgtaggagtctcagggagccttctacaaatgctagagtgactcatttaccaacattaaaccctaggatacatgcaacaaagcaggactccttcctccatggaatgtgccgatttcagatgacacagcacccaatgtagaaaacgctggaatttttccttggaactagactgtgatgagaggtgcttgacatgaacataagctactgtcttttctttttttttgagacagagtttcgcttgttgcccaggctggagtgcaatggcgtgatctcagctcactgcaacttccacctcccaggttcaagcgattctcctgcctcagcctcctgagtagctgggattacaggcacgtgccaccatgcccggctaatttttgtatttttagtagagatggcatttctccatgttggtcaggctggtctcgaactcccaacctcaggtgatctgcctgcctcagcctcccaaagtgttgggattacaggcatgagccaccacgaccggccagctactgtcttttctttgacccttcctttccagtttttgaagataaagcaggaaataatcttctctgaagatacttgataaaaattcccaaaacaacaaaacgcatgcttccacttcactgataaaaaatttaccgcagtttgtcacctaagagtatgacaacagcaataaaaagtaatttcaaaaagttaagatttcttcagcaaaatagatgattcacatcttcaagtcctttttgaaatcagttattaatattattctttccccatttccatctgaatgactgcagcaatagttttttgtttgtttgtttgtttgtttgtttgttttttgagatggagtctcgctctgtcgcccagctggagtgcactggcgcaatcttggctcactgcagtctctgcctcctgggttcaagcgattttcctgccttagcctctcgagtagctgggactacaggcacgtgccaccacacccagctcatttttgtatttttagtagagacagggtttcaccatgttggccaggatggtctcaatctcctgacctcatggtctgcccgccttggcctcccaaagtgctgggattacaggcgtgagccaccgcgcccggccagcaatacagtttttagttactcgacatctttaagcctataactcttaggctatgcatagccccatgtcctaatcaggcattcactgatcccagcaggtctccatctatttgtaccagcctcctctttcctcccaatctcaaggttactcttaaatactagtaaatgcaaaaagaacttgtaaagtggcaaggcatggcctatcaaaagtcagcccaagggcagttttcagccctgcctcacctgggtctagttcagctgacggatgagctgattgatgcgttcaccccgatagccaggtgtgcccatctccttgaggaagcccactcttatttttggtagcatgatgggccactgagaggtggaaagggcgcaagaaccatgagatctcctggaaatgcttccctgggaaggcaatttcatgaatgaggtcttccaagcaaatgaagccaaacttccccaggtgctcctcaatcactgtgttgtctgtcagagggatggtcttattcttgaccttggcttgtccacgtttcaaaatgagttctcggacagacttcagatttggaaatccccaggtcacataaggttccactatatgcagcatttttagattctagggggtaacttttacaaagataccactaaaaattttctttaggcgaagtcttgcagtggttctctgcacccgtaaactcacgccatcaatcctttcgatgcgtacaacaaaggccaaggaatgtttatctggcaattccaaggcatgaggtttcacttctagtcgtctgagacgcaccttgtcacgtttctgccgccaggaatcatgtaggaatgattccagtcgcttaaacctgagcccttttcctttcttctgtcttgctctgccatctttctagtggtgcagctactcaattctttttttaattataatttttattttaagttccagggtacatgtgcaggatttgcaggttacataggtaaacatgtggccatggtggtttgctgtacctatcaactcatcaggtattaagcccggcatgcgttagctatttttcctaatgctgtcccgcccccccacccaacgggccccagttacactcttaatccttatagctcagatgttatgatccacagtgtggttcttacagaaagttatggattaaaaaaaaaaaaaaacactcaaagtgcccgaactttcttaaaataatcctggtacagctaaactcatgcactgactgtccacctaatatttaacagtctgtgttgtgatatattgttttaatgttctgaatgcttgtcagctttcagtattgaagatgtgaatcatttatcagcaatgacacatttagtctaaggttgtcagctatttatgctacaaattaatgacttgtccttaaaatatcaattttgtgattcatgttttggcaggtggttagatgttttgtgttctaattttaaactatggataaaggttttgtcataatcattgttttattggttccttttctcccctgcccactccccaaaaaaccctgcaattcttttttgttaaacttttattttaggttcagaggtacatgtgcaggtttgttatataggcaaattttgtgccacaggggtttgctgtacagattatttcatcacccaggaaataaacacagtacttgatggataggtttttagtcttcattctcttcccaccctcaagtaggccccagtgtctgtccttcccttctttgtgtccctgtgtactcaatgtttagttcctagttataactgagaagaacatgtggtatttggttttctattcctgtgttagtttgcttaggataatggctgccagctccatccatgttgccgcaaaggacatgatttcattctttttatcgctgtgtagaattccatggtgtatatgtaccacattttctttatgcagtcttctgttgatgggcttttaggttgattctatgtctttgctattgtgagtagtactgcagtgaacatacacatgcatgcgtctttatggtagaatcatttatattcctctgggtatatacccagtgatgggattgctgggtcgaatggtagttctgttttaagttctttgagaaatcatcaaactgctttccacaatggctggattaatttacacttccaccaggagtgtataagcatttccctttctctgcaacctcaccaggatctattattttctgactttttaataatagctgttctgactggtgtgagatggtatcccagcaccatttattgaatagggagtcctttccccattacttgtttttgttgactttgttgaagattggatggttttaagtgtgtggtcttatttctgggctctattctgttgcattggtctatgtgtctgttttgtaccaataccatgctgttttggttactttagccttgtagtagtttgaagtcgggtaatacggtgcctccagctttgttcttttggcttaggattgctttggctatttgtgcccttttttgattctatatgaattttaaaatagtttttttctaattctgtgatgaatgtcattggtattttgagagcaatagcactgaacccgctaattgctttgggcagtatggcgattttaacaatatcgattctttctatcccctgcaattctttgttgttgtatttaactatttttacttgtgaagttttttcagggatgattttgttgaaagtgacaactctaaaaattatgttggtaattaaaattttaagtaatgacttttattttcagagattccacttctcttagactttggagctgttaacagcagtgtccaatctgcagtggtactcagcagtttctgtttcctgcatgcagaactgcttatatgaaaacacagttttaaaaatgctttcttatggctgacattcacattcttattccttttgattcttttcaagagggatttggtttgttaaaattaatttttgcaatacttttatgaagatacaaactctgacaaagcttttaaaacaagtttgagagaatacagtattgatttcacttgtaaatctgacgattattttagaaaaaaggaaaatattatttactattattttgcttataaatgtttatcaattttaaagcttccacattgcacatctcccactacaacagtagctaccatttattctttctcaaaaaaagtgctaagtgtgcccttgaaatttttacattgtgcagaatatccctaaaattttaaaacaaaaattacatcatcacttgctttaaatgtttcttctttatttaacatacagtttctaaaatgttagcaaatagcattttagaagagacacgttacttttctaatgaatgttctaaaatgaaccacagtaacctatacttacttagactgtgaaaaacaaaacttatattctattgttaaattttcaaaagtgaaactacacgatagtttacttggcacatcactctgttattgtgaattgacaaatgtatatgtagacaaatatgtgaaaatcagagtacatatacattatatgcagcaccacaatacattttttagtatgttttgactgatatttaattatataatttaccaagaggatctcaccagaatgtagaaaagtattgaattttagaacaattcacatatttaaaaaaaatgtagtcagcccttttatctgtatctggagaatgcagggtaaaggaataatacatgagtattggtatttaaaaaaaggtgttaatttcttacctatgatacctgttactttgggtatcatttaacctttatttctgtgaaatagaggagttctaacatcctctaattattataatattgttctaatttaatctatcttaatctgtgatacagtttgaaaaccaagcttttactattggcatgtgcaaaaaaataaagcagcagtagacttggaatcttgaatgcaaatttagattttgcctcttaataaatgtataatatagtgttctgggaccaattctctaacatttctgagtcctagtttctgcatctgtcaaatgggattagagatacctactttcaggatgtgatatggtttggctctgtgtccccacccaaatcttatcttgaattgtaatccccatatattgagggagggacctggtgtgaggtgtttggatcatggaagtgatttcctccatgctgttcttgtgatagtgtgggagatcgcaaaacatctgatggtttaaatatggcagtttcccctgtgctttctctctctcctgccaccatgtaagactttccttgcttcctctttgccttctgccgtgattgtatgtttcttgaggcctccccagctatgcagaactatgagtaaattaaacctcccttataaattacccagtctcagatattctttatagtagtgtaaaaactgactaatacagagaattggtactggcagggttgggtactgctataaagataatctgaaaatgcggaagtgactttggaactgggtaacaggcagtggttagaacagtttggagggctcagaagaaaactggaagatataggaaagtttggaacgtcgtagagacttgttttgaatacttttgaccaaaatgctgatagtgacgtggacaatgaagtccaggctgaaatggtcccagagatgaggaacttattgggaactggagcaaaggttatttttgctatgctttagcaaaaagactggcagcattttacccctgccctagagaactgatgaactttgagatgatttagggtatttggcagaagaaaatttctaagcagcaaagcatcctagtggtgacttggctgattctgaaagcgttcagtcatgtgcattcacgaagatatggtctgaaattggaacttaggtttagaagtgaagcagaacataaaggtttggaaaatttgcagcctgaccatgtagtagaaaagaaaaccccattttctggggaggaattcaagccagctgcagaaatctgaataagtaacaaggagtaataagtaataataagtaaaaagtaataagtaataagtaacaaggagccaaatgttaataaccaagacaatggagaaaatgtctccagggcatggcagagatcttcggggcagcccctcccatcacaggcctgagaactaggagggaaaaatggtttcctgctcagggccttgctgctctgtacagcctcacgacatggtgccctgcatccctgatgctccagctccagctgtggctgtaaggggccaagttacagctcgcaccattgcttcagagggtgcaagccccaagctttggcagctttcacgtggtgttgggcctgcaggtgcgcagaagacaagagttgaggtttgggaacctgtgcctatatttaagaggatgtatagaaacgcctggatgtccaggcagaagtctgccatggaggcagagccttcatggagaacctctgctagggcaatgcggaagggaaatatggggttggatccctcatacagagtccccactggggcactacctagtggagctgtgagaagagggcctctgtcctccaggccccagaaaggtagattcaccgacagtttgcagtatacgtctggaaaagccacagaatgccagcctgtgaaagccacaggggtaccctgctgagccacaggggcggagctgcccaagggtatgaaagcccaccccttacttcagtgtgccctgaatgtgagacatggagtcaaaggagattttggagcttttagatttaagggctgcccagctgggtttcagatttcatggggcctgtggcccttggtttgaccagtttctcccatttggaacaggaacatttacccaatgcctgttccctcattgtatcttggaagtaactaacttgcttttgattttataggctcatacgtggaagggacttgccatgtctcagatgagactttggtcttggacttttgagttaatgctgtaataagactttgggggactgttgtgaaggcataattggttttaaaatgtaaaaagacatgggatttgagagggagcaagtgcaaaataatatggtttggctctgtgtccccacccaaatctaatcttgaattgtaacccgcatgttttgggggagggacctggtgggaggcagttggatcatgggggggttttttccatgctgttcttgtgatagggagttctcaggagagttgatggtttaaatgtggcagtttcccttgtgctctttctctctcctgctgccaggtgagacgtgtcttgcttcccctgccccttccaccatgatcataagtttcctgaggcctccccagccatgcagaactgtgagtcaattaaacctcctttccgtataaattacccagtctcagatagtatctttatagcagtgtcagaatggactaatacaggatagtaatgaagattacagaatatgtagatgaagaagtgctaagtaaatagcagctattattatgtagtcaaattgaatgtatacattgtggtacttcagtgtcctttaaattgaataactagaaatttgttggctttctcaatctgctcacatcagatgacatgttaatttatgcctatacttttttctagttaatagatataaatctattcactcaacttctattgacagaactggtagtgtggcaagacatctcatttctagttaaggctgtataatattaagttcattttacttaaattaactatggtttgggaaatgcttttcatgtcatcatgtatgcccaatttgatactttagtgggacagtatatttcagaaaaaaacaaatgcttccccaaaaattccagggttgaatacattagtcagacatataacaatgtacttcagagttcctctaagggcaaaaatcgtggtatgaatatacaaaacactcctatttatacttttgtatttttgaaatgtagtcttcatgttaatttagcatttcaatgaccagcatgacattatcttaataatttggaatgccaatatgttcatttaagacttaatatagtaagtatctaaagaaaaaaatggaagtgactgaatgcttttgtatctcttaattataatttgtgctccattgtgatatgaaggatagaaggggcaggatagatagaaaacagaaattaactttgatgtttaaccttaccttaagactgtctgttaagtgacccacataatcttaaaaaactctgtcaagcttaatggatgctactctgcaggcccctgccaggcaacagtcacaaggttatgaggtgcatagattttggaattaggcagagctgaattcagatccaggtgttgccttataatgcgactttgggcaaataaaaggcccaatttttgtattcttatctgtaaaatggactcagtaaaaattatttgagataatttatttgtgtactgtacctaggcatgcagcttgacacacagaattacaagtcagtagtttccagtatgattattattgtgaaagagatattttgtttcacctactgaaaacttttttcagtcttaaattttttatctaactggctgtattgcagatgtctgctatataacttttatataattttaaaaactatttcttttctccttgatcttctaggggtaaggttaccaatgttttcattatttactaaatatagcagcccccaccccttattcatggaggataggttccaaaacccctagtgtatgcttgaaaccacagaccacagataatcccaaatcctatatgtatattgtttttcctatacatacatacctatggttaatgtttaacctactaattaggaagagtaaaagagtaatagtaactaataataaaataaaacaattgtaacaatattccagcatcactattcttgtgctttagggccaccattaagtaaaataagggttacttgaacacaagcactgtgatactgtggcagtccaactggtaacagagatagtgatgcggtttggctgtgtcctcaccagaatctcaacgtgaattgtatctcccagaattcctatgtgttgtgggagggacccagggggagctaattgaatcacagggtctggtctttcccttgctattctcgtgatagttaataagtctcacatgatctgatgggtttatcaggggtttccccttttgcctcttcctcatttttcttttgccaccaccatgtaagaagtaccttttgcctcccgccatgattctgaggcctccccagccctgtggaactctaagtccaattaaacctctttttgttcccagttttgggtgtgtctttatcacaagcatgaaaatggactaatacagtaaattggtaccagtagagtgggtgttgctgaaaagatacccaaaaatgtggaagcgactttggaactttggaggactcagaagaagacgggaaaatgtgggaaagttaggaacctcctagagacatgttgaatggctttgaccaacatgctgatagtgatatgaacaataagatccaggctgaggtggtctcagatggatattaggaactttttgggaactggagcaaaggttactatgttatgttttagcaaaaagactggcagcattttgcctctgccctagagatttgtggaactttgaacttgagagagatgatttagggtatctggtggaagaaatttctaagcagcaaagcactcaaaaggtgacttcggtgctgttaaaagcattctgttttaaaagggaaacagcataaaacttcagaaaatttgcagcctgacaatgcagttgaaaagagaaacccattttttgagaagaaattaaagctggctgcagatatttgcataagtagcaaggagcctaatgttaatccccaagaccatggggaaaatgtctccatggccatgtcagagaccttcacagcagcccttcccatcacaggcccagagacccaggaggaaaaagtggtttcgtgggccaggcccacggtcctcatgctatgtgtaggctagggactttgtgccctgtgtcccagctgctccagctgtggctgaaaggagccaatatagagctcaggctgtgacttcagagggtggaggccccaagccttggcagcttccacatggtgctgagcctgtgggtacacagaagtcaagaattgaggtttgggaacctctgcctagattttagaagacgtatggaaacacctagatgcccaggcagaagtattactgcagggcagggctgtcatggagaacctttgctagggcagtgcagaagggaaatgtgggattggagccctcacacagaatccctactggggcactgcccagtggagctgtgggaagagagccgtcatcctccagaccccagaatggtagatccaccaacaacttgcaccatgtacctggaaaagccacagacactcaatgccagcctgtgaaagcagccgggaggtaggctgcaaagtcacaggggcggagctgcccaagaccatgggaatccatcttttgcatcagcatgacctggatatgagacctggagtcaaaggagatcattttggggctttaaaatttgactaactcactggatttcagacttgcatgggccccgtaacccctttgttttggccaatttctcccatttggaacagctgtatttaacctgtgacacccccctaccccctgccccccatccctccggcccttgtatctggaagtaactagcttgcttttgattttataggctcataggcagaagagacttactagccttgtctcagatgagactttggactgtggacttctgggttaatactgaaataagctaagactttgggggactattgggaaggcatgattggttttgaaatgtgaggacatgagatttggaggggccaggggtggaatgatatggtttggctgtgtccccaccctaatctcaacttgaattgtatgtcccagaattcccatgtgttgtgggagggacccgggggtgggggtgcagtaattgaatcatgggggctggtctttcctgtgctattctcatgatagtgaataagactgacgagatctcatgggtttatcaggggtttccaaaacttttgcctcttcctcatttttctcttgccaccaccatgtaagaagtacctttcacctcctgccatgattctgaggcttccccagccatgtggaactgtaagtccaattaaacctctttttcttcccagttttaggtatatctttatcagcagtgtgaaaacaactaatacagatggctagtaagggactaaccggcagggagcgtctccagtgtggatatgctggacaaagggatgattcacgttccagggcataagatttcattactcagaattgcacagaatttaaaacttattaattatttctggaattttccacttaatgttttcaaactgtggttgactgcaggtacctgaaactgtcaaaagtgaaaccacagataagtggggagtcctgtacctaagattattcctttaaattgtttcagtggatatgtagggacctgagtgtgaagtgagagcagcagcatcaaaacctgagggaaatccagatagcaaaagaaacttgtctagtatactggcatgacagagaaaccaaaaagttctcaagttaatgtgagaatctaagaattaaagaattaagcctttgcctttgagggaaggaaaggggtaatgtggctttaaatcaggttgagattggttctgagggttccttttccttcctttatattgatatgaatatagacacaactgttctgcatttccatttgtttttataaatgtctttttaggatttaggaactgctaattatgcaatatgagatatctgttagtttgaggaacatttgaaaatttggtcaaatgacacagatcgtcacacagttttaagacaaatgtttttacctatttgacctagtctggcaatccctatttgggcaaaaatcttcatttgcaggtcatgattggaggcaggcacagaaaaaaaattgccaccttttttgcattatgtcatcaagacatcaaacttcagcctacaaagtagaaagtgttatttctcaagttgaaggcctggatatacctcagcttctcagttctgacactttatcatagtggaaaatgaagaagattgcttaagaacactgatgttggtgtcagaaagacctgggtttgaaccctgactttactagttacttagatcactttaggcaactcaacttttctaaatcttgtttcttcatctgtaaatgctgaaaatagtacccacctcttaggtctgtggagaggattaaatgagataatctatacaaagaaagagcttgcataatagtgccaagtaatggtgaggttatacctgtattctgattataatctcataaatatttaccatgttagctgtctcagagttcttttgcaaaacagataaagatagaaagtataaataagaaaaataagtgaacatatactgaactttgtacaagatgctggcgatatggagagacccaagacatgggccctacctaaaagagattattgatagaaacaggatacatatacatcaaaaggtaacataggatcatctgtgcaaagtgctatatggcagtgttttaggaagtctagaagctgtcatggatcaggaataccatggtggacacttcaggcagggaaaacagatcttagcaaaagctactcctatcataggtacttgataaatatttgtagaatccaggatccctgtagtgataaagaaactacatggattatgtaggggagtgataagacatatgactggaaaaataaaaagaccaaattatggaccatactgagcttgtactataaacagtggaggagcccttcagatttttaatcatgttgagaaaagagttttagcagtgtgtgggggatagaatggaaagagaagccagtgccagaaggactacttagtatcaaccattgcagtggttaaagcaagaggtgagagaaggcatgcattagaatggcagcggtcagagtggatgggaaggaataggtcctgacatagtgttacagggagtaataaataggatgtggaagatgggttagaattggcaaaatctctgcatgtaagtctgggttactaaatatagtgagagaaattcaaatctctctttaagaatcgaataaaatatttagaaataagttactgttgtatttgaggtgaacacaaatggcatttcaaagatgctcgagataccttgttggaaaaagtcaataactgcactattgtctccaacatgttcttgccttctctgaagacatcatgttcctaattctgaattatgaaccatctattatccttgtatgctcttatgtgtgaggaaccataaggtgggaacaaaatccggtcttcattctagaaataactatgcgatcaaaaagtttttagtctttcttcttaccatactggttcttggtattctgtttaccattcaatgtactattattgcttctgcttaaaactcacatcccctaatgcaagcctgagcaaacagaactgataacacacagcctgagaagggagtgcttggggtctcaagacttattctgtttttctccatctttgacacttggtttgaagagcaaagaaggatacagctgttaggaagtaagttacccaaacacagtgaccaaactggattaattcttccaatgagaaagaaatacattatttctgtgagacagattagactttaagtagcatagataacatgattatattctctctacaaataaatacacaggacctaagaaaccctttacagatccaagtgttttcctctccacttttccatccccaaacccatcttgcaagatatggccagcttatttggagttaattaaatcaagaccttcgttttacagacagggaaaccaagcccagagacactgagtagtaggccactggtgtcttagaggtctgaaaaatcctttactgaacattctcttgatctattaatgtataggttttgttgctgtaaccctctccccaagaggagtgaatataaatgatgcagagtttggatgaactatcttaataagaacctaaagttgaaaccaatgcaaacctctctcaataaatgcaaagcaaagagaataatcagtctttctttggcttgttaaataagataaaatgtgttctgctaaaaccatttaacagaaatattgtgaaaggtttcccctaaagcatttttctatttgatttgaaaactattccatagcttattatcaaacaaatcagtaatcctttagctaatgcagagataaatgggcagtcagaaaatataatcacctggtgtgtgcagctgagtatttacatttttcctaatgaacaaagataagaaaagtgcaggtgactttaatgtgtaaaaactaccttttagtgctagcgctagagggaaaaagaaattactggctcaagccaatcctgtacttgataactaagccgtatagtccatggcttggcttcagttctgttttgaatctctttttggacttgtcttgaatggactgtttagggctgcttcagtagtgcagttgttgcatttttaagcatagtttaggttttaaaatgtttctggtccctttttttttttcttttccactttatgttgcttaaagctttatggccaggttttctcatcctcagcattattgacatttgaagctggatacttctttgtggtgggggctgtcctgtgccttgtaggctggttagcagcatccctcgcctcttctcacttagatgccaatagcatttccccaaccgtgataaccaaaagtgttttcagacactgccaaatgtctcctagagagcaaaattgctctctgttgagaactactgtgttacggtgtttggacaaaaactgacaagccaatgggaatattctattggtagttgtaaaaaattaatccagttatagcagctgtatttctggaatttttttccatattaacacttgctttctgaggtgataatatctttgttttttttctcccaaatagatttcttgcattacactgaaaaattgctgattaattcacttaaattgaagactaagccaatcatgtcatttgggtaatagtttaccaactctgcccctttctctgtcagggaagcctctaatttagtaagcgatactgtatccttttgtcaggtacattaccattcctattagcaatagggcaattgagattgagaaagattaaaaggtcaccaagctattacattgtagaattaggttatgaattgtagcctatctggtttagaatctttaccttactagtctccataacaacaattcttccagtgtggtccatggggccctgggagtctccccttaaagggcagactattttcacagtaacacgtactttatttgccatttcattatgtcagcatttgcaataatggtacaaaagcaaagatgagtaaaactgttggcatcttagtatacagtagttactgtattcactgtcatgcacttaaaatctttgaagaagcaaaaaaattattaattacattaaatttcaacccttaaatacatgtggtctttctcatgtcagtgtgacaaaatgagaaggtgcataatccacttatatcgcatatagcatttgatagttgtctcaaagaaaagtgtataagattaaactgtgagttaacctactttttttcatggagtaccatgagagataaactctggttttcagccttgggtatttggcgatgttttcccaaaaatgactgaagtaaacttagcactttaaggaaaacaacttaaagtatttgttgccaattgataaaatataggtttcaagcaaaaatcagaatttttgaagacttgtatctgccactgtgagcttgacaaatgtgactcttttatattacataatgaactatgtcaacatttgaaagatctgcataactcagtgaaccagtattttccagatgactaatgcatgataatacaaaatcatgcatgggtaaaagatacattcaaagtgcaagatagactgacatatttcaatgtaacaatcaaaagttcattgataacagttttggattccacattgcaatactaaaacctttaaaaaacgaaattgtccaattttggtgtagtaatcagaaaaggcaatctataattacctgaacttaagtttctggaggaccattaaccttctacaggctcatggggaagactgtagcacttctctttccctaagatcctccagaaaggaagaaggtaatccttgggggtagggtagagacctattgtgtgatgatcaccaagtatgtaacaatgctttatataactctaatatatataatccacacaaaccccctaaaatggcactaataagggaatggactcaaagaagttaagtcagctagccactgtcacagctattagagcactggaactaggatttgaacccagatttgtctgtatgtaaagctgattctcttcgtaatagtactgagacacaagaggcggctacaaaatattctggtactccatcctagaccagagtttcaaggttcgttatcatttgtagcatgatactggatcctcacagtgcttgcctttcattcaggtgccaggaaacgtctgcctgaatgaatgggtgtaatttacctgcacattttacatgcttctctaggtgtgtgattaactcataatccatccatgactttcacccataatcctccttgtagcaattgctttgcttgcaacaaaactaagtagacatatctagctttatgcatggttttctctctctgaactctaacataaactcagcctcaggaattattcggtttctactacatttgccattctgattgggaaccaccagcattcaggtattcacctggaacaaggcattttgttccaagggttcctcacttaaaagcaagcaccctagcaatagttcataatggaacttcttaacattctcagaatgtttggcacagctgtgagtgaacacacattgagcaatcaataactattacagataatgatgcccttaagaccaggatattttagctttcccattcaaagggggtgaaatatgcactcttactatggtatacttttggttccttctgccatgtatccttaataaaagatgtcaattccatatggttttctcttgagttctaaccattttgttgtaccctagcccttttaacaatatcaaacttgcaactgaataccatttagcattcatccattttttccaatggtgttcattataggctatcttactcctcctatttgtatgacaaaaattggcttttttcaccgatgtctatggtacatctggcagctttccatgtactcagttcttatctgatgtagcccagaacgactgcctgaagggatgccaaaagcctgattgaggttccaaattttcagctactgtactatcaatccatttgttcatttttactttcccttgtcatctgtagcttacagttgagtggcctgaacatgttttgcatacattgtaatatctaagaatttgggaatacggtcctaggatttagacttaatactaccttccatttatataatacttactcataaaatcttcagtgttcctgaaaaagaaaaaggaacatgtattgagtgcctgctagaagcaggaacttgtagtagattttctatgtgttaccttattttcacaacacacacacaggtgatatccttcccagtttactgatgaggaaactcaggggtcaaagtagtagatacctacccaaggtaacagaagctgtgaagtggtacagctgggatctaaaatatgtcagcttcaccgtagataggctccctgatgaaccacctgccacggcccgtatgaccgcatccaggggtgatgatgtcattttcacagggttattgagagctaaaactacgaagtactataaactattatttaaaatataaatacatactatatatgcatatgtgtgtatatataattaatggggtaaacattacagaatactgtcctaacctttaaacaatgcactcgttttctgtaaactaatatacaaacaactgtttggtccctaaaaatagatgtcaggtgacagagactggctgagcaagaataggagtatcttcagaatagaagccagaggagtttttgcttccccaacacattgtcgcaccattcactgttccaggaccttcctacttctctggaaaactctggcccaaagcagctcctctacattagtcacaagtttccattaatcaggggtggcctgtgccggacctacagcagagtcatttcaggttattctgttacaggctttcgacgtgtagtcagtccactcgcccaaatctagcagggaatgaatgccttgtaatacggaagcatctacaaattcttcttaacagtgttcagagaacaatgtgaaaccctggggccttttcccagaattagggtggtgggaatgctgtcctattgactaagcctgttaggtaagcaggcagttggcaagattcaggaagcttcatttgaagatagaatttagggcgatcgtttggatttactggcttaattacttaaggtaacatttataaaagaaattgtcattccattattattaccttttaacttttattcctaaacggaacattagcaacaaactacattacttgataaatgtaatttctaaccagattgataactagaaaaaaattttaagttactttgctctgtgaattagtttaaacatatttgtaattgagacttactactgttattggctgaaataaataaaagcaagagataataaagaataacagagacaacgaacacccaatttaagtttatttctaagttccatcttttttagagaaaaggcaaattaagaaaagtttagagagaggtactagtatatttatgaacttgtatagatgataagcaaaacggactttaatatgtagaattccagaatcaacaggttgccagcatccatgtttttgaagatttgcttaagaacacaaccaaaaatggaatgggcagtctctaattacaagcagaaggctacaaaatcattttagctgcataatacagttttggttctaaagtcagcacgtaagaggaaaattccttaggaaaatacaacattgaaaaccattgtgtcatgtaatatgaaatgcaataattaatttttcctccagtaatagaaagatcactgtttcattggtttataaaaatatatctttatcattaaatgtggcaaaatgttaagacttggtgaatattggtgaaaagtatatatccattgtacaattctttccaattttttttgagattgaaaatttttaaaacaacaaattatcttttaaacagctaataatcactagacctgcactctttgtggtgagactatgaaaaatgttagagacctagtaagagaagcagattcacatttctgtcttcttcttcaagccaaacagtcatagagtggagtgggcagaatggaactcacttttgaaagcctagtgctttgtccaatcttactgcaagccagacaggaaggttatagaaaatgtttctggatcagtcttctctgagtcatatgaaattgtggtttcagccaagatgacattaggaattagagacatgggacaaaaactttaagattgtaaaaaaattttgactctagtaggaaacatgggtagaattgtaatgacacttgattgaattttaaaagatgcctgtataagatcttaaaattaggaaaaaaattatggcctaagcaattaaaggcataggaggcatctttttgggatgatggaaatatcctctctcctgattgtgatagtagttacatgaatattcatttaacaaaaaccataaattatagacttagaaaacagtaaatgttactgtatgtgacaccttaataaacgtgattataaaaataaatcctaagcatctaaaaaaaaaaaaaaaaagaagaagaagtgaaccagaaccacaccattctattttggagacacttcaaaagaaatgacctcattcttaattttgtttaaagaagaatataacatgatttgaatatatttagctaggatattttagtgcctgctagcacttgaagccagagttcactgtgagcattctgactatgaagtgagaagctaagagaactgtattttgatattcctttgacagttaaatcataacactgttcttccccttctttagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagtgtgtgttttgaagagtttatttttcctctacttggttttcatttctcagggtggattttgaaatttccattatatgcaaagcccatgaaaggctaaatatcagttaagaggggagaggagggtggctcctaggtcctctaatgggcaggaaagtatttaaaacgacaatacaaaaagatctagaataaaatagaaaagtacaagttgatgtctgggagtttggtcagggagcataaggtaacactataagaaagtgctatcatatgaaatgatggtgttaagtttgggcataacataatgttcattgtattagaaacatgggctttaacttccataagctaataggtttcaaagtcaccaactttactggcctggcaaaaatgagtcacagtgagaactgtgacaggaaaaaaaaaagatattcatttcatttcttattcattttttttttctattaagccagggcactgtgctaagtggtataaataccaataagacctgatccttaccctctgggaagtcacactccactgaagtgaaagatgagttaacaatgacaaggtacagagattataatatagatgagggagagagaaactcggcctgaggaggtcaggaaaggtattttagagaaactgatttcactatataaatgttgtattaacacaaatcttactttgttatggattcagactgctgacagggcaacagcattatctccctaaagaatgagaaattcattccatagcaaatttattagaagagagtctaaaatgtcctaatactaccagtgactcctctaggaaaaaaattgtcatataatttagttatttctaaagcagtttgaaagtagcttggcctaaagctctgattatattaattttttaaagaaacaattattcattcactgtatgaggattattattatttgtctcatgttgtgtttgcatatccatgagagttagatgagtcattttcttttgttttactttttaatacattagcaaattataaaattactcatattacaccacaaagattacaaggatggcagctttggccagtgtagtagtcccacctattgattagagtcaaaagtaaagcccagccctgctttgtgcattgctcctaataaagtggatgttacttaacacatacgcagaagacagaagcgtcttcgtgtcctcactttactcctcactttcttaactgcttaagtatttccacgatataaatgcagtgataataataatacggacagtccctgacttaacgatttttcaacttttatgatggtgggaaagtgatacgcattcagtatggctcctcgacttacaatggggttgcctccagataaacccattgtgaattgaaaatatcttacacttagcactccattcttaatacctgctagaattatagattatccctcaaaattggcatagtataatatgggtatcagcaagttgttgcactttattcagagctttacactaggcaggggtgggctttacttttgactctaatcaataggtgggactactacactagccaaagctggcatccttgtggtctctgtggagtaacgtgagtagcattataatttacatcccccataacaaatgatccaagagagtatgtgatcaatgcagcagaactattgtcttttattatctgatttcacatgtaacatgccatcacttctgccatattttattggccacacagaccaatcttggtaaaggacggaaagggactgcacaagaccatgcattcaaggaggcagagatcactgggggccatcttgggaggctggctaccacacccaccataaatagaaaaccagaattatttgccaaaaatagactttaaccacaaaaatgaataccatataaacaaaacaaagtcacaaaatttcagctgacttgaagactcatctttctattagttagaaagggaatttaccaagtagtagaagacacaggaactccaaaataagatatctcattgtcttatcagaagggttgacaggaaaatgggctgggcactgtggctcaaggaaaatgggctgtgcactgtggctcacacctattatcccagcaatttgggaggccaagatgggaggattgcttgaggcctggagtttgagaccagcctgagcaacataacgagaccccgtctctacaggaaaaaaaaaaaaaaaaaaacgttatccaggcatcgcacctgtagtctcagctactcaggaagctaaagcaggagattcaggctgcaaagagctatgacacaccactgtactccagcctaggcaacgtagcaagaacttgtctaaaaataaataaataaatgagtcaaggaatgaatgaatggattgacaggaaatgactattagttgtacgtggccatgtgttatgaaatagtgaatactagttaaaactcctcattttatagataaggaacagatagatagacttgtccaacttcatgctaataaccacaaagggctatttttaacttatgaaggtacattgcctctgatcctatagctcagagtcttagctgtgcacaagacatacctgggataaagaaatcaagattggcgtaatgtgcacatcctgacatttcagttggatataaacaaaactttggaatttttcatttttagcagtgggtgattttttttctttttttcttccagtaactgtaggacagtgatttagagattccttatagggtataacttttttgtattataaccacttcatcaatagatgtatctgttgatcgtacttttgatttataggggatagaattgggttagtgcttccattttctgtccaagtaaagaagctaggatatttatagagtacaaaaagaaattgaaacagctggtacagatatttggcattggagagcagctctgaacaaaggtgaattatagtctagtggtcaattttgtggcctgttctttacaaagaattgaacctgatacagttaaccatctaccccaaactattatttgtttaaaacacaatctattggctgggcgtggtggctcatgcctgtaatcccagcacatcgggaggccgaggcgggtggatcacgaggtcctgagatcgagacaatcctagccaacatggtgaaaccctgtctctactaaaaatataaaaattagccaggcgtggtggcgtgcacctgtaatcccagctactcgggagtctgagccaggagaattgcttgaacctgggaggcagaggttgcagtgaggtcatgccactacactactacactcccagcctgggcgacagagcgagactccatctcaaaaaaataaaaataaaaaaacataatctatcaaactgtgtaaaacacagtttatcaaaaaagtagttacccttggtgggtactggctggaattgggcagaaagggggcctgttggggtactgttctgtttcttgatctgagagctgattacataaaggttcttggtttgtaaaaatttattaaatggttcactgatttgtgtactttttttatatgtgaatactgcaataaggttttttattgcactgttttcagtttgttgaacagaaaaagggagactctttttgttgtttttgacctctcgacctcataatggcaatgtaggcaagaacattccctcaaggcaatacctgtgggtgtcttggttatattccaccggaaacaaagacagaggctgtccttataaaatatgtttgaagacctgtgaaactttaatagtgccttttattccatataggacagcacaattacctatgtgctggaaggaatgattgcatcatcgataaaattcgaagaaaaaactgcccagcatgccgctatcgaaaatgtcttcaggctggaatgaacctggaaggtaatataaatatctgaaagcaattgtttgtctctgtagcttataaaaatttatcattttacttttgaagatacacgtaagcagatgtaattaatgtagtcagttcagtatatatatgcttgactagcataatgttactgcccaataaaaatgggaaatttttttcatgaatatgtcatattgtttgtttatccaccagttcttcttacacacactgaattcagtacagccagactatatacaaagaaaggaaattatgtaataatgaaacttacacaacatgcagcaactttattattcttactccttttttcagcctcaaaactattccctagggttggaaatgtttctgtatcagacatatttacatgtccatttttctgtttgccttttaaaagcataccttttacttggagatctgtgttttattacagatcttcaagcggggggtggtgggaaaaaaaaaacctcaaggaagaactggatgggttttgttttggttttcaagtaaagaagaaacctgggccgggtgcagtggctcacgcctgtaatccccgaagtttgtgagaatccttctgtctagtttttatgtgaagatattaccttttccaccgtaggcctcaaagcgctccaaatatccacttgcagattctataaaatgagtgtttgaaaaactgctcaatcaaaagaaacgttcaactccatgacctgaatgcacacaacagtgagaagtttctgagaaagtttcttggtctccccgcactttgggagaccaaggcaggcggatcacgaggtcaagagatcaagatcatcctggctaacatggtgaaaccctgtctctgctaaaaacacaaaaattagcggagcgtggtggtgtcacctgtagtcccagctactcaggaggctgaggcaggagaatcacttgaacccgggaggcagaggttgcagtgagccgagatcacaccactgtactccagcttggcgacagagcaagactccgtcttggaaaaaaaaaaaaaaaaagaaacctgaaactagttataagttagagtttcatatccctgtttatataacaagttgtataattaacactgatctcagcattaaaaaattttcctctgaaaaaagtttggaattctgctgtggttgaaattgcaagttctgtgaaggtagtggtgatctcataacacatatgcttagtatttattgtgaaattagcacttttattcaacaaatatgcaccaacaaggcagtcactaggtataaaatgaataaaatagtgcctgtattcaagtagtttatctgctagttaggttgcagagtcagtcacaaaatagcgtggcacaccatagagggcatagggccacaggaacaagaggaaggtcacctaattctgtcttggaagtcaaggaagaagtaacattgaattttaaatctataagctgagtaggaattagatagatgaaaaataagggcagagacatgatcagatttgtattttacaaagactaatcttacatggagagaccaattaagtgaatatggcagtcctccagataagagatggcagtactgagagagaatggaaaccatgtggttccttttatgattatgatgattattattattttagagacagagtctaactcttgtcacccaggctggagtgcagtgacatgaacatggctcactgcagccttgaactcctagactcaagccatcttcccacccagtagggctacggatgtacactaccatgcccagctgatttttttttaatttttgttttaattttttgtagagacaaaggggtcttgctatgttcccaggctggtgtctaactcctggccttaagtgatcctcccaacgtggcctcccaaagtgctggtattacaggtgtgagccactgcaactgacctatgtggttcttttgataggagagactaattgttggtgctatctagcacacactgtgtgtagacatcttgttaaatagaaaatagatttatgggtatgactatgaagagtctaattccccaaaccacacacacaactctatctacgtttgaccaggctatttaaacttaactgcagagtgtcagcatgttaaacattgatttacataaaatgatagctgcccactttcttgtaaatgttataaaaactgcagagattaactaaaaaatgcacacagaagtttgctttcagttccacaagggtagtttatttttgttataaaaacagtattccccactttcttagataccagatctctgcccagattttacccagtttcatcttgctgctctctaatctcctatgtatgtaatatactttgaccatttaaatatgtattaagacacttgagtttttagtgccctttggtttattttctccggtcccaattatctctaatcttcattttttcattttacctattttatatttcgaaataggttttgaatgaagctcaaaggacaaacccaaataaaattctgtcgtatctctaatatattgtggttgcttacccagtaacatttttaggtgcttttctgaatacatataaagtttaagatctttggagttttaagtatataatgtttttctgggcaatttctccctatccaaactatgagggccttctttcatcaaaagaaaaaagatatatcaactacaaagtaatgattttgatggactaggctacgaaatctgtccattttttcctccttcttacagtttaatagcaattgcagtgccctttgcccttactgtactagaagacgaccccaggcagtgactgacatctgatttttctattaattataccatcactgccatttccagttgaatcttttgttggacatcagaaatttttcttacatgaataaaatttaagcatacggttgggcgcggtggctcatgcctgtaatcccagcactttgggaggcctaggcaggtggatcacgaggtcaggagatcgagactatcctggctaacacggtgaaaccccgtctctactaaaaatacaaaaaattagccaggcgtggtggcgggcgcctgtagtcccagctactcgggaggctgaggcaggagaatggcatcagcccaggagttggagcttgcagtgagccaagatcgcgccactgcactccagcctgggcgacagagcgagactccgtctcaaaaaaaaaaaaaaaaaaaaaaaaaaaaaaaaaaaaatttaagcatacaatttaggctgcagtttctcaaaatattgtattaaaaataaccaattatatgcttttatagtcagtataacgtatccagttagtgtagaaattggcatttgttgaaaactactacatgttagtctttgatatacattcttctactttttggaccctgattattaaaaacacctttgaatagggccatgatttactttatatccatttttatactacatagtggaagaaaattctgatttgttatttcctactatgatatgtaccgtgtggcacatatcatataaatgatccaattctacttgtagatgaattgaaagaaaggcttaaaaaagttcttagggtttgtgtgtgtggtttcactgtaaaactatcatttttgtattgaactaacctcagtatacataaaatctttatttggcctggtatgtacgtatgccaggaatctttggcagaccctaacacttacaatacagatgagccatgtgtttcacactttttttttaacaaccttcagaaatattctcttgttcatcagagtgcttcccctaagccaagcagtttcgatgatagccccagaataactttgcccaagtctctccataaatgtaacttaggactccaagtggtgtatttttatactcttgccccataccaagtaaatctcaagatttattttaagggagtggccttcactgcttaaagggcctagcatttaagaacagataagatttttaatggtgatcctaaatgtttttttttaaaaaacttgcttgtttttctcttgaaactaaatgtttttattcacttcattttaagatatattgtaatcaatccaaagtatggctttatttttagtataaacagtcaaatgaagcttagtcttgtggcattgtcagatttataaccaaatattactgaaactaatttttttaagttcaaaaacccaatctagtagtttctctcttattttcaacttttattttagattctaggggtacatgtacaggtttgttactaagatacattgtgtgatgccggtgtttggagtatgattgaacctttcatctaggaagtaagcacagtacctaacaggtgctttttaacctgtgcctcccttcctctatcccccctcttgtatttcccagtgtctgttcccatctttatgtctatgtgtactcaatgtttagctcccatttataaatgagaacatggtatttgtttttctgcattagttcatgtaggatactggccgcctgctacatccatgttgctgcaaaggacgtgatttcattctttttgtggccacatagtattccatggcatataaataccacattttctttatccagtccactgttgatgggcacctgggttggttccatgtctttgctattgcaaaccatgctgcagtgaacatatgggtacatgtgtctttttgatagaatgatttatttttctttgggtatattcccagcaataggattgctaggttgaatggtagttaaactcttaattctttgaagaatctccaaacttctttccacagtggtgtcattgtggttttgacttgcatttctctgatgattaacaatcagcatttttccatatgtttgttggccacacgtatgtctttttttgagaagtgtctgttcatgtcctttgcccatttttaatggggttgtttttgcttgttaatttaagttccatataaactctggatattagggctttgtcagatgcatagtttgcaaatattttctcccattctgtagattgtgatagtttctcttgatttgcagaaactctttagttaggtcccattgtcaatttttgtttttgttgcagtttcttttggggattagtcataaattctttcccaaggccaatgtcgagaaggttatttcctaggttttcttctaggattttcatagtttgaggtcttacatttacatctttaatccaccttactaatttttatatggcagtaggtaggggtccagtttcattcttctgcacatggatagccagttatcccagcaccattaatggaatagggagtcttttccctatggcttatttttatcaactttgtgtagattacatggctgtaggtgtgtgtctttatttctggactctattctgtaccattgtgtgtggtttttttttaccagtaccatgctgtttcggttactatagcctgtagtatagtttgatttggggtaatgtgatgttgccaactttgttctttttgcttaggattgctttggctatttggggcattttttggttccataggaattttagaatgctttttgctaattctgtgaaaaatgacattgtagtttgataggaatagtgttgaatctataaattgctttgggtagtatgaccattttaactatactgattctaccagtccatgagcatggaatgttattccatttgtttgtgtcatctttgatttctttcagcagtgttttgtagttctccttgtaaaaattttaaactaacttagatgcattcctaggtattttactctttttgtgactgttacaaatgggattgcattcttgatttggctctcagcttgaacattactggtgtatagaaatgctactgatttttgtacattgattttaaatcctgaacctttaccaaagttgtttatcagctccaggagccttttggcagagtcttcagggttttctaggtatagaatcataagtgaaaagagatcgtttgattatttattttcctatttggaagccttttatctctttctcttacctgattgttctgactaggatttccagtactatgttaaattggaatggtgacattgggcatccttgtcttattgcattaaggggaatgcttccagcttttgcccatttggtatgatgttggctgttggtttgtcatacagggctctttattactttgaggtatgttccttcaatacctagtttggtgaaggtttttatcatgaagagatgctggattttatcgcaactttttctgcatctattgagatgatcattattttttttgttatgtggtgaatcacatttattgatttgcatatgttgaacgagccttgcatcccagaaataaagcctacttgattgtggtgaattaactttttgatgtgcagctggattcagtttgctagtgttttgttgaagatttttgtatctgtgttcatcagggatattggcctgtagttttgttgttgttgttgtttctctaccaggttttggtattagaatgatgtttcccttgtagaataagttagggatgaggccctctttctagattgcttttttagaatagttttagtaggattagtaccagctcttctttgtatatctggtagaatttggctgtgaatccatctggtcaagggctttttttaattggtaggttttttattattgattcaatttcagaactcgttattggtctgttcagaatttcagtttcttcctggttcaatctaggcaggttgtgtgtttccatttccacatacatacttactccaaataatggctttatatatacgggggtcagctgaaaacaaaaatgatactttcatagtaaactccacccgcccccccacccacatacacacacacataaaccctagattttttaaagcctttgttccaatttatccatttcctctagattgtctactttgtgtgcatagaggtgcttgtaatagtgtgaagatctttttcacttctgtggaatctcttgtaatgtcatcttttacattttttattgtgcttatttgggtcttcactctttttttctttgttaatcttgctagtggtctatcaatcttgtttatcctttcaagtaaccaacttttataaactaggttttaagctaattaagatttctctactttcattaagaaggaagtagtgttaccacagactcatgaacacttctgtggagctcctgtattgactgctaatcaactatatgctccaatgggtcaggaatttatataaagttgtattaactaagttgctttaaaatagtgattgcttaactaaatgattcagttcagttaactccttcctgaagatattttgaaaaattaattagtattatttcttgctctagtcagtacagcacagttgggttcaattgtactttctgagctgtattgaaaaacatcagttttctcatttagaactatatataagtagtgagaaattaattacaaactgagtcatagaaaatgtttttttttaatcctccagcttgttactctttcttccttgttctaatgtggagtaaagaaatatgcattccaaaccatttaaagttatgactaattgaggctgtcaaagtactgtttcagtgtattgatttggcacatgtgtgttctcttttacattgtcaacaaaagtacattttatgattttggatcaagatttcactgagatacttctggttgtttaaagagtttctttatgtattggtgtctttcctttttaaaattttatcactcctctattaagttgtgatatccaaatttaaaatattctaaaaacatgttctcctgcaagttgaggtaatgatagttgttatgtggtacttactataatatatgccaggaactgttctaagcattttacatatttaattctcacaacaaccctatgaggtagggactaatattgtcctcattttacagaaggggaaatgaagagtcagggagtaacttgcacagatatccagctacaacatggcagaaccaggacttaaatccaaatatgctgatttcaggtttctgccctttagtcctatatcatactgtgcctccaagagagcatggtaaactaattagcatggttctatcatgattctgtttctattttgaactattaataaaaatttttgcaattctcagttaccccatttagtatagaacacaataagaatggaaccattctattctaacattgtacattgagatatcgttcccaccaccatatctgtcctccatagactatatggtgtgtcattttaaggacagaggatctaaaaatgatttttaaaggtgatttacatttactcttccctttgcaaaatggtttgcatccctaataatttagacaagtacatttcttcgtgatataaattacatttcttgcctttccctggaattctgagtactttccctctgagagaacaatgtaattcttatttatttagtcactaaaataacttcaggagtatgaataagtctactaaaaagtctacaggatccatgttgtagtttgagtagatggttccataccaagtcaaggtaaaagataatttatatataatatgaaaatggctgctttaggtttatagagtaatcaatataaatcttccttataaaagggaaatttcccacttataatttatgtaatgtaaagtttttcatttcatcttcccaaatgtttttagtcccacgcagtatttatgttagtacctatgtaaaggtgaaaagtgaattttttctactggtagaactaatactatttttagcatgtaatctgctgtcatcttcctatctttataagtggctttgaacaagtgtaaatagtgtaattctcttcattatatatactaccatgatttagattaatcttaaaccacagtttgtaatccgttactccaagcttagatttttttttcagtttatagtaagagtaatttgccttatataaccaatgaaattgttgcatttagagtgaaagtgagataaaaaaataatttatagaagaatttacaaaagttatttactcagattgttttaacataccgttataatactttgtataaggaataactctaatgaagtttctggcctatttgtaggcaaaattaattgggaataggttcctctggatcttttgctttcagaaaaaaaaaagttttttctccttttccatgtcactttatcataattgctaaataaaatatttctcccatcttaatagttttagaaagtaaaaatacttcttgaataaactgtgtagcgcagaccttcccattacagttcatttctatgtatttttttaaatacccacagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtaagatgcaaaacataaaagagcaactatataaacctttgtgttttcttcagcaaaaacactttggcttttatatcatcgtgagcccatggcttatcttgtttctcttagttctggggactatgaaggggagagtcaggtgaatacaggtgatagggagtttataataaaacatttacattactccctgcttttcaaatcattatgcacaggatggtaatttcacataggatgatgtaatatcagaattcaagttacaagactcactcaaaactccttttacactgaagtttggggaaagaaaatgtttttagttaattccatttgttttccttcattgtgccacttttaaaaatcaggttgtttgtaagattggtaaacatcaagtatgttgattgtcaaaatttgtactaaagtagaatgattttaacccttcactaaatgaaatgctacacattgaatgtaattttaaagataattttaaataaaagttaccctattggaatttggtgtggaatggcagaggtcaatgttagtgtcagctctgactttaaagacagggaattgacaagcctgtgttcacgcaaatagttagggagagagcaagaaagtaacctgacctcctgtcatccttgttttattaagggggaaagaggtgtgaatagcagggcaaatgttttgcttaactcattgattaatacctcaagccaagattcttttctgttttttaaaatcaatacataatagttgtacatatttactgtacatatttatatttagggggtacatgtaataatttaataaaagcatacaacgtgtaaggatcaaatcagagtaactgggatatccatcacctcaaacatttgtttggggaacattccaaatcttctcttttagctattttgaaatataaagtaaattattgttaactatagtcatcctgttgtgctactgaacactaaaacttatttcttctaactgtatttttgcacccgtcaaccattcccgcttcatccccatcaccactatctttcccggtcactggtaaccgccaagccaagaattttggctattttactatttagttcatgtttacttaagcagacagaggtgacaaaactggctttttttttttttacattaaaagctattaaaaagcacctagggggctgggtgcgatggctcacgcctgtaatcccagcacttgggaagcccaggtgggtggatcagttgaggtcaggagttcgagaccagcctggccagcatagcaaaaccccatctctactaaaattacaaaaattagccgggcatggtggtatgaatctgtattcctagctacttgggaggctggcactgagaatcacttgaacccgggaggcggaggttgcagtgagccgagatggcaccattgcactccagcctgggtgacagagcaagactttgtctcaattaaaaaaaaaaaaaaaaaaaaaaaacacaagagggtttgtgagtcttaaagtgtcagatgacagaagaaaactgtgtctacctagtatttaatttccattttctgttaggggtgcccttgttttgacagggctaattgatctcattgctccttggcaattcccacagagatgatcttctgaagagtgttgcctcatacctttatttctcttaattcaggtttcaggaacttacatctggatgaccaaatgaccctactgcagtactcctggatgtttcttatggcatttgctctggggtggagatcatatagacaatcaagtgcaaacctgctgtgttttgctcctgatctgattattaatgagtaagttgtatgtgtgtcattttccctgtattcatagggtatctttaaccagctgatgttttcctgattgactgctattgtgataattcaggactgaaacaatcctactaggtatctaggatctaggcaaactggaaatagagttatgagtgcttggggcaggacaagtgtaatgtaaagcaaatgtacatgtggcattattactgtcccaggacatgtttgaggatatttaacagcatatctgaggttagtaaagtctgtcgcaagcaacaaggaatcttactgtgatatcatttacataaccctattccagaaagaaaaaggagcatggtaaaactcatgtggattcagtggggacaattgtagatgaggatatctaggctgatggggtgggacatatggacccagacacaagaggtatctctttgcatggcaaggctcacccagtgtctgtggtttaagaatatgggaacaaatttgttttgtttaactgagagaagaccaagcctttaagattttataaatcagctattctcttatcctctaagcttattcctgtgtctgcgaaatacttcaggtgtccatttccccttacctcattgcagttgtttcctcactcgttttctccctccagtgtaacgttcatcatgttggctaatgtttgcttcctcaagcacagtctgactgcatcacatatctccccagtacacagattgtcttcagtatcttcccactgaccctccagtacatattctgcatgatttcagactttccagaatctgacctcacttcctctcccattgttttccttcacacactcttcattcccatccatcctttccagcatactcttagactcttggtgttcacatcaccagatacacagcagagaagtcacatcctagttactctcactttctaccttgtattactacttttcgtacccctagcttattgctattagtacaatgtaaacagggagttcacacacacatacccctggtctaagaagaataaaaaatgaaggagatttctgtttgtatagaaaacagaagtcaccttgacttttattgccaaaaagaggactgttcaaactactgcatcacaatgtaacaagattaggtagttggatccaattttaaattaactggtaaatatatttagtttctggggaaactgaagacattattactcatcataatcctaccatgctgtttaaaaaataccatgttggcagtatttgttttttagtcactttctaatatgtaatttgaaggcatttaagtggaattaaaagcataaacagatttgtatgaaacaccaacttatcctggtttataaaactaacctaatttagggtttttattattagggcattcagatttagctttaagcagtcacagcaaaatctaatcatgccacatacattccttacataaagtgggatttataattttttttcctcaacagatttacattagtttcattttcattaagggatatgtacttcctattcttgtgttctcatgctgctgcctaaaagatgggcagtcctccacctttttcttttcttttttttttttttttttttttgagacgagtcttactctgtcacccaggctcaagtgcagtggtgtgatcttggctcatggcaacctctgcctccagggttcaagtgattctctgcctcagcctcccgaatagctgggattacaggcgcactccaccacacttggctaattttttgtatttttagtagagacggggttttgccatattggccaggctggtcttgaactcctgacctcaagtgatccacccactttggcatcccaaagtgctgggattacaggtgtgagccaccgcacccagccctccacccttttttcttagcccactatgtttccatactgctctggtgtctgtgacaggcagatattgcatatcagaaagtatgcattcaagttctgaccctctatagagctgtcaaacagtctctcatggttgcccttaggtcagaacgttgtgggggaaaaaaaaattgttgtttttacagccaacaagaatgagtttttacttattctactacactataactttgttgaaattttcagttatatgagtataaccatgtacaagaaactaaaggaaaaaaaggtgcctcccagaaaaggagtgctttacctactattaaggactagggaggtgcctcttcggtaagagcagattttaaatttgaagagcctctgatcactttggcagcatataagtcatgtctaatttattttatataaaggaataaaccacatattcagtagagaaaaataataacctttctgttgttaagtccaagacgactttctgtcagaaacttaaaaaaaaaaaaaaatcttgaagcattttaaaagctgtgaactgggcccagtttcaggctcttagtgtcatttcacaagtcaggaaactttagagacctatttgaaaatcataggtatgtaatgacttcagaatcataagcaagaattggtttagtacctttagtttaaagaatattaaggcatatgcctgtcagaggcagattttgagcatcagaagtctagaatcaagttctaggtctcgccctctgcataactgtgaacagtgtcacacatttttgtctttaggatggactgctgtgaaaaaatttacctttaaaaatcaagtgtgtaggacctaaaactgtcgtctaattgaccgtattcaaatgataaaccttgatttaaatgagcaactagtaataagttctataagaattctaacactttaattaaataataaaataatacatggcatgcatgatagaaaataatatctccactgttacattagattattcattagtctatttaaacagccaagatgcaggaagtttaaggaaagttctccaaaattctgattttatagggaattagcaataatattattgcagtagttgtttttctttatgagttcatagttttgcaaaacaaaacaaaaatgtgctttttggggggaagtagcagtatttctaactaataccctgctatttatctttcacaggcagagaatgactctaccctgcatgtacgaccaatgtaaacacatgctgtatgtttcctctgagttacacaggcttcaggtatcttatgaagagtatctctgtatgaaaaccttactgcttctctcttcaggttggtagaacaccttttcaccttatgtcaaaagcatgaaatatgaaggcctagaaacaaaggttaatttatatacatagtactaataattataccaagtctactattatttcctactagtcagatgatttttatgaatgtaaaatattagaaaggcacagtaagtgacaccaagattaataagacaaataggtatggcagaaacagagaggtatatgagctgcatagggatctctgttgataagaatctgtgtagacttttttctccttccttcctttgatctttgatcatgggaagacatggaaaaagaaagctaactacagtgattttgtctactacactgttatttggttaaaaattttagtttcctaatgagtattagcatgtatgagaaattatgggagaaaaaggcgcatcctagaaaaggtgtgcttaattactattggggattggttaacatagcatgggagctggattgtcagagattcattatctagaaaatggcaacaagagtttataaaacgaacttctgtgagattactttttagctagcaaagacaaagatgtccttcagtaggtgaagtgataaactatgatacatccagatgatggaatactattgaggactaaaaagaaataagctgtcaagccatgaaaacacatggagggacgttaaatgcatattactaagtgaaaaaagctaatctgaaagggctacatactgtgtgattctaactatataacattccataaaaggcaaaactgtgaagacagcaaaaaaaaatcagcggttgccagggtttagaaggaagggagggataaatgtgcagagcacagaggatttttagggcagtgaaaatacttcgtatgatactacaatggtggaaacatgtcattatacatttatccaaacccaaagaatgtccaccaccaagagtgaaccctcaactatggactttgggtgatgatgtgtgggacaggaggtatatgaaaaatctctgtaccttcctcccaattttgctgtgaacttaaaactgctctaaaaaaagtcttttttaaaaaaagctctatgaactagttggtattataaaccttaggccatttcaagtaaaaattacatatcaatgtttattaaatactgagttaatagctgaatacctctttcatatacaaataagtacatttgcaattttttaaaaagtcttaattccattagtaactgtggtttcatagttgccaaataactgtaagctatggatgttgcacaagactgtgattttatttaatcatttcatatctatttaaacatttccaaagcgcacattcatcttaatgttttcacactatttttgctcaacaaaaagttattttatgttaatggatataagaagtattaataatatttcagtcaaggcaagagaacccgataaagatcattgctagagacgtttaatgttacctgtagcggtacacttgttaaagaagtgattaagcagttacataaaattctgatcatagctttgattgataccatgaaggtataattcagtgcctggatactaacaactttacttgtttaaaaaaaaaaaaaaaagaatggtttcaattgtatacatcccagactaattgagctatatgatttttttcattgtaaataatatcacgagttcttcttgttaaaaaataatagaatcataaggatggaaatatataccttaagatatagacttctactatgatagactactggaataggtatataacctcccaccaaaaatgctagactaaaaaaattaagaactaagtgaaggcaggaacctacagagataagtggaactcaagccaacttgctctttgacggcatttgtagaacctggtaaattagtaagtttagtaagttggggtttttttaagtttataatcttttttaaaatgatttcaataggtttttggggaacaggtagtggtaggttacatgaataagttctttagtggtgatttctgggattttggtgcacccatcacccgagcagtgtacactgtacccaatgtgtagtctttcatccctcatcccctccccaaccctagtccacaaagtccataatatcattctcatgcctttgcatcttcatagtttagctcccacttagaagtgagaacatgcaatatttggtttcccattcctgggttacttcacttacaataatggtttccagttccatccaggttgctgcaaatgccattattttgttcctttttgtggctgagtagtattccatggtatatatataccacattttctttatccactcgttgattgatgggcatttggactggttctgtatatttagtaagtttaaaaacaagggatggaaatataaatgcagttgaaaaggcagtggatggatctaaaagcagaagaatacaattgtttttaatgattgtgtatatgtttgtgtatataaaccacaagggaaatctgtaggtactgaaaatcacaacaggaaaatggcaacaaagctatagaaactggaaaagcaatgacttttcttagatccctcagagaatggaggtcataggacaaaccaccacttcaaaatctagaagaatagacaaatacagagaaacagccaagatcagcttactgggaaaagatgccactgaagccaggaagactatggcaatttgggaaaagatgccactgaagtcaggaagactatggcaattttgatgaattgctggaggctgagtgaggactagcttcagagttaaaaactcccagggacccagtcttagtgggggtttcctgcaatttcttgggtttaccccacaaaatttctaacttccagaaactccacaaggttcttatggtgaagatgcaagaaaaattccctcctttttctggtaggagtagagggaaggtaaaatttggaaatacgtagcagagtgttcacaacaaaaggcctgccctgtaaggaaaactaattcaacaggcccttatgtgacctgggggaaaggcaaatagaggattctagcccttccttagccttcttgtctcatttctgaaagtcacagcccagggattcagacccactaaaaaaaactgagatttaatcataaagattaaaaaacaattcccctccccctccccaacaccttaccaccatataaacagggctccaggataaaataacagtggattacaactgagagagctgcaagacacaagctgtttaaggagctcttaggaaacccaaaaacaacagaagaaaaagtaaataaaaacaaggaaactagaggaaactgaagcctccagtacctacaattatggcaaacattaaatacagcccagctcctagccagattagcatgaaacctcacactaaaagtctaattacttcagttttgatatatcaatcatgtccagctttcagcaaaaaaactacaaggcatgctaaaaggcaagaaaaacccacggtctgaagagacaaaacaagcatcagaagcagtcctcagatatgacacaaatatttcaattatcagatagggaatttacaatacctatgattagtaggttaaaggctccaatggaaaaaagtagacaacatgcaagaagtgatgtacgcagagagatggaaactctaaaaataaatgctaaggaatgctgtaaggaaatgcagaatgatgttgatgggctcatcagtagactgagcacagccaagcaaagagtcagtgagcttgaagatagataggtcaaaggaaattcccccaaactcaaatgcaatataaacatagtagacattaatccagctgtatcagtaattactttaaatttgaatgctctaagtacaccaatcagctatttttttaactaggaggtgaaaataaagtttgccaccagatgctcactaaaaaattattagaggatatacttaggctaaagaaaagtaatcccagccaggcgtggtggctcacaccggtaatcccaacactttgggaggctgaggcaggcagatcacagagtcaagagatcaagaccatcctggcttacgtggtaaaaccccatctctactagaaatacaaaacttagctgggggtggtggtgcgcgcctgtagtcccagctactcaggaggctgaggcaggagaatcacttgaacctgggacgtagaggttgcagagagccaagatagcaccactgcactccagcctagtgacagagggagactccatcttagaaaaaaaataataaaagtaatcccatctttaagaaggactgaagaataacaaaagtggtaaataatatagatacatttaaactgacatttactatgtatataaaataacaacagtaacaatttccttgagggctaaaaagtagaactaaagtaagtttcaaggatgacaactagaaatagggtatgcagggtatgcaaagtaccaaaccattgggggaagagaatacctaagaaaaacaatccaaaagaatgaaagacatgagaggagggagaaaaaaatgcataaacaagggcatgataacaggaagtaacagataaggtacattagtacagctaaattcaaacacatcagtagtttagtttcattaaatatagagatggggccaggtgtagtggctcacacctataatcccagcactttgggaggctgtgggcagatcacttgaggtcaggagttcgagaccagcctgaccaacatggcgaaaccccgactctactacaactataaaaagccgggtgtggtggtgcatgcctgttatcctagctactcgggaggctgaggcacaagaatcatttgaacctgggagatggaggttgcagtgagccaagatcgtgccactcttctccaaactgggtgacagagggacactgtctcaaaaataaaataaatgtagagatggactgaatgctccaagctaatctgacaggattttagaaataatccaaatttatgctatttaaaaaaagctatatctgaataaagatattgaaaggctgaagtaaaaggatctactttgcatagtataacccaagacatggccaactttttctgtaaagggccagatggtaaatgttgttagctttgcacagtctctgtcacagctactaaactctgcccttgtggcaggaacatagtcattgacggtactcaaatagaacaggcatggctgtgttccaataaaactttatttacaaatacaggctgcaagtaggatttggcccataggccaaagtttgctggcccctatattgaccaaaacaaaaccgaaggagctacattattaccaagcaaaatagatgttaaggcaaaatactccttaaagcatttgttcaggaaaaataattgtaaatatatagtttcaaattacataatacaaaaattcatagaacaagaatacttagataaatctagtaaaaataatgagattttactatacctttcttacaaattaagcagacaaaaaaataaggatatggatgtacatttcatctctcttgggtcaatactgaggtgtgagatcactgggacataggttgagtgtgtgtttaaatttatttttaaaattgccaaacttttccgcaattgttaacatttaccagaaatgtatgagacttcttaagatccattctatatcctcctcagtacttggtactgtcagcctctttcatcgtaggtatactgatgattaaaaatattaagcatcttttcatgggcttattggccacctatatttcttatttggtattgtgcctcttttaatcttttgcccattttttaactgggttttaagaattgttcaaatattctcaatgtggccctttgttaaatatatgttttgcatgttttctttaagtggattacatttacagttttcttaaaaaaatgtagagatgagcaaaagtgtataattttgaagaaagcttcgtgtctttgtttactaagaaagttttgcttaatccagggttaaaaagattttctactatttgttttcttatagaaattctgtagtttcagctcacatgcttaagtatatgatgcaaggtaagggacaaggttcattttcttccccaaaatccatatctggttgctccagaacttgactctcttttccctattgagttacttggcaattttgtagaaaatcagttgtttgtatatgtgtgggtctactttcagactctttttcttacccaacgatctgtatttcttacccaatgatctgtatgcctatattcatattgataacaccctgtcttgattactgttgcattacagtaaatcttgaaatttggtaatatgaattctccaaatctgttgttcttttccaaactgttgttttggatattctagtttccttgcatttccacttccttttttttttttttttttgagatggagtctcactattgttgcccaggctggagtgcagtggcatgatcttggctcatcgcagcctcagcctccccagcagtgggattgcaggcacccaccatcatgcttggctaatttttgtatttttagtagagacggggtttcgccatgttggccaggctggtctcaaaccctgacctcaggtgatccacccacctcggcctcccaaagtgctgggattacaggcatgagccactgtgcctggtcttccacgtattttttaattagcttgacaatctctaccaaaaagtcttttggggctgggtgtggtagttcatgcctgtaattccaccactttgagaggccaaggcaggcagatcgcttaagcccaggagtttgagaccagcctgggcaaaatgtcgaaaccctgtcactacacaaaatagaaaaaattagccaggcatggtagcttgtgcctgtagtcccagctacccaggaggctgaggagggaggtcaaggctgcagtgagccatgatcatgccagtgcactctagcctgggcaacagagtgagactctgtctcaaaaacacagtctgatagaatttttattaggatagccttgaatctatagatccatttgaaaataattaacatcttaaatttccaatttctggccgggcgctatggctcacgcctgtaattccagcacgttgggaggccgaggtgggcagatcatcaagtcaggagttcgagaccagcctgaccaacatggtgaaaccctgtctctactaaaaatacaaaaaaattagccaggcgtggtggcacatgcctgtagtcccagctactcaggaggctgaggcaggagaatcgcttgaatctgggaggcagaggttgcagtaagccgagattgtgccactgtactccagcctgggcaacagagtgaggctccgtctccaaaaaaaaaaaaaaaaattccagttgttgagaaagaataggaattccagctttggaggagtggggagaccatcaaatcctctttccaaaaatactactaaaatactactgagcagagtatagttccacaaatagtcttctgtaaagagactcacagtacatatttgtctttgtaggccatatagtccctgttgcaatttctcaattctacagctataacaggaaagcagctatatacagtatgtgaatgcttgtgttctaatacaaatttatttgcaaaatcaggaaaatggcttgaaatggtttaagatctagttttctgactagatcatggtatataatcttttccatatatattttgaatttggtttgctaatattttgctgatcatttttatatctctctttatgaaggatgctgatctacaactttcttttcttgtgatatctttttctggctttgctaccagggtagtactagcctcttaaaatgagttgagaagtattttctgttttcttaaagagtttatagagtattgatcttatttattctttaaatatttgatacatgttaccagtgaagccatctgggtctgtgttttctttcagggaagatttttaattatttgcttatttgttatatagatctattcagaatttatatttttccttgacatagttttgtaatttgtgtgtttctatgaaatgagccattttgtctgagttgtctaacttgggcataaagttgtttgtaatcctttaagttttgtaggatccatagaggtgtcccctccattatagattttcataatttgtgcctgatcatctttttttcatggtcagtctagttaaaaatttatcaattttgttggtctttacaaagaaccaatttttagtttcattgaaatttttagtttcattgattttctctttttgtttcctatgtcattgattattatttcttcttttctgcttgcttttcatttaatttgttcctctttttctagtttaaggtagaagcttccattgttagttgaagaccttattttcttatatagatgtttaaagctatacattttttgtatattttcattcatttcattttctaatgtccttcatgatttttttcattgacccatgtgtattgcttaatttttatatatttggggattttccatatctcttcctattcatttctaatttaattccactgaggtaggaggtacattgaaggactctaatattgaatgactccaataagtcttctgagacttttttaggcacttgcatatggtctatcctgagtgttccatgagtgcttgaaaaaaaacttactgtgctcttgttaagtagagttttatgaacgtcagttaggtcaagttgattgatagactaattcaagttttctgtatctttgctgattttctgtctagttgttctagatcctacaactttgtctacatccttgccagagcttggtatggtttttttattatcgctatcctagagagtatgtagttgacccttgtgacttgccatgcatttaatgactgcccatgttcatagcagcattattcataatagcaaaaaaaacttttatcatatgcttttgtgcctcaagatcatatatttttcgtttttagtcactaatatggtataatggtataatatactgtttaatttctgagtaattgactagcctttcattccggggataaatcctatttggttatgatatagtatcctttttacatatagctgaattcattgtactaaaattttggtatttttgcatctaaatccatgagggatatattctatagctttggtgttatgataatatggtattatttctttcttaaacgtttggtaaaactcagcagtgaagctgtcttggtttgtttggagccttttttgtagaaaggttttcaagtacaagttcatcaaatgtttactgataatatgtttattcttgagtgagctttgttggtttacatctttgaaggaatttaactgtttccttcaaatgttgaatttattggtataaagttaagttattcataatattcccataatatccttctaatggctccagtatctctagtgttattccctttcattcccgacattggtatttaatatattcttgctttttttttttttttttaatcagtctggctaaaagtttttcagttttaccaatgttttcatagaaccagcttggtcttgattttgttgttgtttatgcatgttcttagttattcgtttctactctttatcctttccatttttcttgtgtttagggtagaagcatatataattaattgagacctttcttttctaatcaaagcttttaatgctgtaaattttctaagcactgtcttcattgcatcccacacattttgatatgctgtgttttcagtactagagatttttaattttatgataccttatttaatcatgatgccttatttaatctatagcttattaaatgtcaaattctaaacatttgggtttttctccagatatgtttgttactgacttctattttaatctcatttttgtcagacagcattcattgtatgacttaatcctcctaaatgtattcagacttgttttatgttctagattaatgttctgtgtatacttgaaaagaatgcaagttcttgggtagactgtttcagaaatgtcagtcaaatttaagtcttgtttattcttattgattctgagacaaaggtgtttataatgttagatttgtctgctatatctctgacattgccaaatatccccttggaggcaaaatctccccctcccttttgagaaccactgatctatgtagccttttttctgggactaatttagccttgcttctgagatgtggcccctaggtctctactgaatgcccggcatatttaattagatctttctttcctctatggcctcaagggatttcaccctaagtatgcacaaatttttattcagccgaagactgtacagatttctggaggcctttctttgtgtacctccttcgtttccagtagtctgacccataaattgtacagatttctggaggcctttctttgtgtacctccttcgtttccagtagtctgacccataaattaaagctgctttagcctccccaaacttcaatctctttctcctcaacccagcaagattgctagaccctgggttccctttcccttcactgcagtatgataattactttcaagcacaaaggtttagaattaagatttcttactcctgggctaggtatggcttaccgtatttgtttctcttttcctagggatcataatcatgtattgcttgttgtccagttttccagtaggaggggaattccaggctgtacttacttcctgcagccaaaagaggaagtaatgttagtgatttcaatattaaaacattaaaaaaaaatttaagatggatgaaattcttttatatgcatattgaattgggcttcaccatagttatttttagaattaggactaaccggcagggaaaaaaactatacggcagggaaaaaaactataagccatcgctgttttacaattttgcaataattagattttctgtagtatagtaatgtgtaaaattaacccattgttaatatagaatgccgttatcactcctgattaagcggtcttcattttcatgttaatactgatgtcttgtaatgctttctggaatcaaacattttcatacatattcattagtctaattctaatcataatccaatgaaaaagagcaggaaagatgctcaaggaggttatattcaagtccacatggcaagtaagaaataagactactcggctgggcatggtgacttactgcctgaaatcccagcactttgggaggccaaggtgagcggaattgcttgaacctgggaggcggaagtggcagtgagctgagatcatgccaatgcactccagcctaggcaacacagcaagactctgtctcgggaaaaaaataataataataagacttctagaagctcctaaatccatagcttttcctctataccagcatcttctaaaaatgtcagcagcagtgaagtttcagtttgggaaataatgcatttcccctctctggagagtgcacagttatatctccaagaagtactgaaattcagaagtctgcctaatatgtattaaacatttagcttttctcaaactttgaccaccaaatcctttgtctcgctctaactatagttaacacagaatcagtgttcccaggagcacactgtgaaaaatgtagcactctacaaaagtcctaatctccacaggattaagtgaaaccatgattaaccctctgttccttgtccttattagtaccattttctgaagagtaatgtatccccccaaaacttttatactagtttcactaaccagaatccatgtacataaggaaggacagatatttgctccctactaagacatatctattagctacattaaaaaaagtattgcatgccgattttaaagttataattaactggtgatatcacagatattccaagatataattgctggaataaacactgttgttgaagccttctatctatctcagtactagaattaaactcaagtgcagaatggcagacaaagttaactaaaaatcactgtattatttcatttggtcctccaaatagctttgtgagctaaggaggagaaggtgtatcatcaccacttccattttatagatgagaaatcaagtgatttactcaaggttaagtcctccaattctttgttatcctgcattttctcttggctgtagtttaattaataatcctaagaaaatgcttatattttagagtgcagtaagagtacataaacaatgttaaatgcccatcttgcatgtataaaaagttatagcaagaaatctggctgggaatggtggctcacacctgtaatcctggcactttgggaggccgaggcaggaggattgcttgagcccaggagtttaagaccagcctgggcaacatagggagatcctgtctctacaaaaaaatttagccagacacagtggcttgtgtcctagctactcaggaggctgaggtgggaggatcacttgagccaaggaggtcaaggctccagtgagctatgattatgccactcagacatggtggcttgtgcctacagtcctagctactcaggaggctgaggtgggaggatcacttgagccaaggaggtcaaggctccagtgagctatgattatgccactgcactccagcctggatgacacagtgagaccctatctatctcaaaaaaaaaaaaaaaagaaaagaaaagaaaaagaaaatcctttaactgacttcatcttaaccttttagttcctaaggatggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtaagtgtcaaacataaagccaaatataagagttttctgggacaaagtatgttttgattagtgaatataattatataccagcagcgcccccacccccgcccccagtttgtggatgttggtgatagcttgagttcaacttatgaacttcagttttgtagacatttttcctaaggccaattatgaaatatcctttcacctagtcatgtgtatataaaatcaccatgttattacagaatttagtaacactgtttttaaaaagtatgattaatccattaaattagaataatgcacccttcatatattatggtactacagtgattcatgaaataattctatataattctacatacaatcaaagaaatataaaatgtgttttgtacggaagtgcttatttttcatctggggaattccagtgagattggtatattctaggccagataattttttcaaaatagaggacaacaaacatgagatgttcccactgaccaatttggaagcctgatcattaccatatcttctcttgcaggtggttgaaaatctccttaactattgcttccaaacatttttggataagaccatgagtattgaattccccgagatgttagctgaaatcatcaccaatcagataccaaaatattcaaacggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttttgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcattatgtgactccaacatgcttttgtagaacttgtacagttccgattgtccaatctgatttttgtttactgaaagtagagttacccctgcttcaggaaccttaagataatatggtgggcatttaaatgtcagtgtggcaatgttcgcctgctaatatggcatagattcaaaataagcttaaccctggtgccaaagacctgaagattatcccatccatgcctcaaatggttgtgtgccaattactgcaaagggtactaagggaaggagaaattcactcctgaggctgcttcaaatgtatgtctttatcacaaaagatgacattttatgtaagctaatgttatctagtcaaaattcttagcttattttaaaatcaactcttcaagaaaaggaataaacatttaatataaatatcatagcagtattgcacatagaatagaaaggtcgggcagggtagtggaagtcagctattctatacaatccattcggtattttccaaaacatttgatgttcaggccatatccaggaactggatgacctaacaaacttctctgagtacctttttttccacaagagatctccatcactaagaaaaaaagcattgtgatttaaaagccaaatttgccttatccatcatcatgtgcaccaagtatttgctacctgcctactatataatattgaagatacaacgtgaataagaaaaatactattgctaccctcaatcagagtatgtgattggaaaagtgtataacaaacctttcccagtgtcttcaggtataatgcagagataccagatacggcatcaatgtgtatacacattatggctgtaccattcactttaag

SEQ ID NO: 9 - DNA, 2034 bp, H. sapiens
ggatctggcagcgccgcgaagacgagcggtcaccggcgcccgacccgagcgcgcccagaggacggcggggagccaagccgacccccgagcagcgccgcgcgggccctgaggctcaaaggggcagcttcaggggaggacaccccactggccaggacgccccaggctctgctgctctgccactcagctgccctcggaggagcgtacacacacaccaggactgcattgccccagtgtgcagcccctgccagatgtgggaggcagctagctgcccagaggcatgcccccctgccagccacagcgacccctgctgctgttgctgctgctgctggcctgccagccacaggtcccctccgctcaggtgatggacttcctgtttgagaagtggaagctctacggtgaccagtgtcaccacaacctgagcctgctgccccctcccacggagctggtgtgcaacagaaccttcgacaagtattcctgctggccggacacccccgccaataccacggccaacatctcctgcccctggtacctgccttggcaccacaaagtgcaacaccgcttcgtgttcaagagatgcgggcccgacggtcagtgggtgcgtggaccccgggggcagccttggcgtgatgcctcccagtgccagatggatggcgaggagattgaggtccagaaggaggtggccaagatgtacagcagcttccaggtgatgtacacagtgggctacagcctgtccctgggggccctgctcctcgccttggccatcctggggggcctcagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgcccccatgctgttcgtcgtcccctgggcagtggtcaagtgtctgttcgagaacgtccagtgctggaccagcaatgacaacatgggcttctggtggatcctgcggttccccgtcttcctggccatcctgatcaacttcttcatcttcgtccgcatcgttcagctgctcgtggccaagctgcgggcacggcagatgcaccacacagactacaagttccggctggccaagtccacgctgaccctcatccctctgctgggcgtccacgaagtggtctttgccttcgtgacggacgagcacgcccagggcaccctgcgctccgccaagctcttcttcgacctcttcctcagctccttccagggcctgctggtggctgtcctctactgcttcctcaacaaggaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctgaaccctgctgggaccccagctagggctggactctggcacccagaggcgtcgctggacaacccagaactggacgcccagctgaggctgggggcgggggagccaacagcagcccccacctaccccccacccccagtgtggctgtctgcgagattgggcctcctctccctgcacctgccttgtccctggtgcagaggtgagcagaggagtccagggcgggagtgggggctgtgccgtgaactgcgtgccagtgtccccacgtatgtcggcacgtcccatgtgcatggaaatgtcctccaacaataaagagctcaagtggtcaccgtg

SEQ ID NO: 10 - DNA, 2439 bp, H. sapiens
ctccgggaacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaactccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatccaaaaaaaaaaaaaaaaaa

SEQ ID NO: 11 - DNA, 3318 bp, H. sapiens
gtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaa

SEQ ID NO: 12 - DNA, 78001 bp, H. sapiens
cagattccgggtctcatccctagaccaaagatatctgaatcatttggcgatgggtccaggaacctgcattattcaacacacttcccaggtgaccgtaaatgtcaaaagacaaaattacaacaaacttaaacatcttaattggcttcattcatgattctagaatcgggcaagacttcattcctcaaaatagcacaagtgtcccaatgagctgagcagaggaggttggttttatagacagaaaagggctgaaaaaagcagaaacaaagaacaaaaagcagattggtcatttcaaagttactttccttgtaaggcaggaacagggaaacagaacaagagagaaataactgattggtcgcatcgggttacttcaggttactttttgttgtaaggattaaagcaaagggaacttcattatgttgattaaaacggtctgcttgggaaatcagggtgtgtatctctcttctgattttgtgaaaggttatcagtctgatgatgtagaactttagcatgagtgactccattttgatttttagtctagtctgttgagaccctaatgccagaactttttttgtttgtttgtttcgctcttgttgcccaggctggagtgcagtggagctatcttggctcactgcaacctctgcctccagggttcaagcgattctcctgcctcagcctcccaagtagctgggattacaggcatgcgccaccacgcccggctaatttttttttttttttttttttttagcagaaaccgagtttcaccatgttggtcaggctggtctcggactcttgacctcaggtgatccacctgcgtcggtctcccaaagtgctgggattacaggtgtgagccaccacacccagcccttttttttcaagacagggtctctctctgccacccaaggtggagtgcagtggcgccaaaacagctcactgcagcttccacctcctgggctcaggtgatcttcctgcctcagcctccccagcagctgggccccaccacaccggctaattttttaacttttagtagtgacgaggtctgattctgttacccaggctggtctggaactcctggcctcaagacatccgcctgcctctgcctcccaaagtgctgggattacagatgtaagccaccgcgcctgggctcctatgatttttatttaacataatgcaccatggaatttgtgctctgcttagttcagtctgagcaggagttccttgatacttcgggaaacactgaaaatcattccatccccatccattcattcctgcagcacccaagtggaaattctgcgtttcagacagggacactacccttagagagcagtgggcttccccagcagcgtagtgaaacatgatactcctgagtttcatgaaaaaagggcagacatctggccagagctgggaggcaggaaatagagcacggtgccctcctcccatactccagcttggattactgaggctggggcccaggccctgcaggaaaggaggtgcatgactactttaaggccactcactctgtgactcaacgggccgggtcggggctggaactcaatgccctcccgggcctggagagcccacgcgccgtgggcggggctcccggggtcgcctaggcaacaggcgcgcgccgcgcccgagcccagagccccaaagcggaggagggaacgcgcgctattagatatctcgcggtgctggggccacttcccctagcaccgcccccggctcctccccgcggaagtgcttgtcgaaattctcgatcgctgattggtccttctgcttcaggggcggagcccctggcaggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggtgcgggagcgccccggagcgtggcgggcccttcgcttaggccgcttgaacatcccctcagacctccaggccccagactccctctgggtcttgccctctgcctcgctcctactgcttgaggattcgatgggacagcgacgcactgcgtccccccaccctttgtccccggggcgggcgtgtttctcgccgcagcgtcggagcccccttcgatcccccacctcccttctgttctccagctcgggtgatctctcaagccgggggaccgccggtctgtgctctcaacgcgaatccctcgcaccccgaccccgccccctgcctgtccactctttgtcccctggggtgatttagcacccccactatttccttttctggagtggaccacctcagactctcttcctttgtctccctgggggaaaaggttactccccccgtccctccttcacatttcctttcccctagtctcagtgtgcgtcgagtcccagagatgacagtcccctttcccctttctgttcattcatttattggataggagttggcaagcttattctgtgctaggcaccgcttaggcattggaggtggtgtttgctaatcaggacaggcaagatcctagccttagtggggcctagagtcgaatagggcaatcaaacacaaaagcaaataatttcagatagtgacaggtgctgtgaagagaacgacttcctaacggggtacagggtgactgcatagaaggccggctgtcttagagaaggggatcagggaaggcctgtcaaaggaggagacatttgctttgtgagctgaaccaagaggagcagaaagccgtgagaatatggggctaaagaaccttctagccaggaggcctgcggtacccactccattggggccatgatattattctttcaggcagggactcaggaaggttaacgttttaaccctctctaaaatagcatctttcctcaatgagcagcttagtctttggtcgtggcagagatgaccttgtcttaggagtcatctccttgtgtgttaaaaagttaggaaaggagggtttctcatatatctataaaacaagtagttaaaaacacaaagagctcttcctttcacaagcagctgaataagatacatactcccaattaaatgtcattgcgggggttgttaagattaactaaaaccacacttgcacagtatcttaaataagcgatatacagaatagagagattttgttacttgtgtaaagggagacagcagatgattctgttttcagcttataggctcaaaaggcaaattgtgagatccatcagctgtagtattaaaatctattttgagctccgcttagaaaggaaaaaaggtttaagcagttctttggtatgcttgactaacaaaagcctttttttttggcagccttgattttcatgtggatttacatcaagcttatttgacaggattctttttatttggactgtagtgtgtatattagtttctgctagactaatatttctaaccactgtaatctatatactaataagtatgattgatcagtatataaaatttgtatgccatatctggtctctgaattagctgaatgaattccataagggactttgagactgtgtagacaaattttctgcatcagtttaatgcagtagagtctaaaatgtctttaaatgaaaattgttggtctgaagtgttggagttgattatgatacaccccatcacagtggaagcattgtggagagaagtcttttccactgaaattgactgagttgacaacaagaaatacgtattgtaacttagttcttagttgaattttatttcttacaattttaagccagagtgggttgacctgtcacccaagcatggttaaaattgtattcagcatgcaactagcatggagtgtgtcagtcttcaattcatttccttcattgttcttaagtttttctgccacaattaaaccccacaagttagtcaaggtgttgagattttcactgcttcttaatggattgccacattccctgaggtagtttcttttggtcttagagaattgtcagggccagcttttctcacctccactgtatggatatttttcttttctaagatcttgaaatcagaagcttttctcctaagtgtaaaagtagctctttgtcatacaactgtagcgttttctgaaacagagttcagatgaccttgagtctaaagtggctaactttccaaggtgtgtatcgctttaccaaaaccattatttttcaaggattcaaagaatgtgtttacaattgatagaaaatggaagtttaaaaaaattaatactttatagcatgttgaaatgagggcagccttatacaaagtcatactttgagcttgcctagcctattgtgatcagagaataatgtaatttttgcttacaacttggtaagcaggtcagttattctaacttattttctgattagaacaaaaagatgtaaaaacttgaaaactattgggaaaagaacaaagagtgaagaggacttttgagtgctgaggaatgtggcagcttggaaaacaaactttttaggcagagattctttgctaggtcagtttgataaagtgagcataaccgtatttttaatctttaatgctaatgaatagcatagatgctaataagcatctaggtctataaaaagtcagctttgatagtgtatatagatggctttaaacattgttttctagcatttaaacactttcaaatcatccggttgcttgattgggcctagctgtctaagaggagagaatgagcccagatgaggaaaagagattgattttactgagctagaatgagaggagagagggttgagtgaatgaaaagaatagctcatgtgctcccctccatctgtagtttaagaggggttgggtccggtgttttgcttgttttctcgtctgtaaattctttgattctctgacaccactcactatatttcattgtgaatgatttgattgtttcagataaaggggactgcaataataccttgtgacatgaaggcaagatttattcatgttagaggcaggctttgtaaaatgggccactcttccaattgacatttgtttttatagctgttttcattatgaaatacaatctaatgcctgactaggttaaaaccatgttgtaacaatagttcactaaaattccttactgatatacagcttatgttgttatattccaaaaagatgaatattaaaatttgccaataatgtttatttaaatactattttcttcagaggaaaaaaaactattttatgcaaaggagaaagatctatacactatgactcacttcacttaaaaaaaaaaagactaacggaaatgacatggagagactgggaagttctagtcatcttgagtgacccattagatctaaatgttcttgtttagccctggtttgagtgaactaaatttaggtgtctgatcagtactttggaaatggtgtaaatgcctttgtaattgtctggactgatattagattaactgggagcacaagtagaaatagtgaaggaaagaactttttgctattgttatttgacatcactggcatatttataggaatactttggtgtttttggaagtaagtaaaccaaccagtggttctaaaaagtcagctgggggataatggtaatgccgctgtttcttagctgcaagttatctgccgttacttctcctccattttgcattttatcttgaatagctcctcaaaacctattaaaatacctggtattgaataatgtaattgaatgtgtactgaatttcacagtggaaatgaataagaaatttcctgtggaggttttttgacttagctactgaaataacggccttttgttgtgtgattctttcccttttctctttgttaaagaaaactgtcttgtgatcttgtagattacagaatccttttggcaatttctgttcctagcactgctttttctttctttctttcttttaaatagaaatggggttttgctgtgttgcccaggttggtcttgaactcctggcttcaagcgatcctcccaccttggcctcctgaagttgggattgcaggcgtgagcaggtactttttctgaggcctgcctgagcctatatatattttgcacaatttggcattcctccctacagtgtttatgctgatttgtttctggtaacaactaatactggcaaatcggctgggcatgttactttatgctgcccatattcaggaaaattggaattctagctgggtcattgttcccagatgatgtagtttggcaccagccattccatgttcacattttgagtatccaggagggctggggactttggagtagttggtgattccctctgccacatttcactggttggtcactatggcatcctttccaccacactagtagtctaggttctcagatgttgcttatgagcctgcaatggtttctagtttcacactgcagaaatgagtgaagccggttacccgttaatatggtcccatcatcactagagtaattcattgttctaaaaccagatctgagtctctcactcctctgcaactacttctgattctttcataacacttgtaaagtccaaactcctctttagcatggcagccagcttccagtccttccctcctatgtggcttccattctagccagacaagaaagggcagcgttctccaaactcatcctcgcccttcattcctctataccattgctgagcactttgttgaggatgcctctcccgttcaatctagcttgcatcttccagctcgaatgtgtgcttccttgcaccagagttttgttccgtcacctgtgtgttttcatacaagctggcacatatctcttctaaagccctgctgtcattgtagctgcgtctttacaaacattttttttttaaatttttataaagtcaaggtctcactatattgcccaggctggtctcaaactcctgggctcaagtgatcctcctgccttggcctcccagagtgctgggattataggtatgagacactgtgcccagctgtagctgctactttatatcccaggtctatctccaatggagcccaagcttcctgaggccacctgttgtatctttctcattcatcttgaagtcctctgctcctggcacagagtaggtacctaacaagagttgggattgaattgatggtcagtactttgctagcctgatggtataaagatgtacaaaacatgttcctggctcccactctaggggggcaatgatggaaacaaatagattagcccacattagtaccaatagtagaggtcactctgggagaaggcccccaccacattttgagtcatggcctaatgaggtaatttagtattgcctgctgcagtggctttggaagaaaggctggcattcttagccagtagaagctgataccactgatttgtttcacagaagctttaaatataacaataaatttgtgcttggcctacggtgaactttacaggcaacttggaggtaatatgtttgtctctctaagaattgttgaattcctcttccctcatccctcctgactggttctcacaagcctagcgggcctttgcatgtggttggttcataaaatactttttgattttgggatataaaatatagttctccataaaataacgactgttaccaagtctttgattttttttttcaaactataaatggtaatgacattctttggcctttgatcagaccacccttaggggcaagagagtagtttcatgttttgctttttctagtgtcccctgtgtctgggtatagttgcagtctcagctgtcatactaacagtgctgagtgagtcccttactttctttgggttttggtttctcccttgtaaaaatgatcctggactaactgatcattaagttcaggtcaagtaataaaaatccttaatgtactcacaaatacaatttaatgttcctgaataatccttgtaaaaactgcagcagttactcagttttgtaaggtgtggttgggtactattaggctcaaaagtttataggagctttgtgagtatagttaacaactcaaaagaatggggtgttttttcccgaggggcatgaaatgtttttgataaatagagttcatttgacttggtaatgtggaaaatgagtagccctgacacgtacgctatgcttttgcagtttttctctcaagtagcaattgggtggcttttcctgtaaaagatagaggaactgattcttgagaatttacgaaagcttcaaccctaactaggtatgcaaagaatagttgccctttatgttgtaattttaggaagaaacctacatctggtctaagtttcatttgaataatatgatagtttacacatctgccatatttgagaagaaagtacctaagtctccagcattttagaaataatgctttactttgtgtagaaatggtctttagagtttaatagctgctgccctctcctttttcaaagcagcttgacataatcatgagtatcttgctgacagcttgtaaattttgattgtatgaaaactgaaaataagaccatttcacatggaagattccctcctgccctgaaacagccaaagaaaactgtagccatcaaatctattgatctctgggctttggtacaagtcacactactacaaataaaataataccaagtacttataaatgattttcagtccttttaaagtttatttttttaatattttttttgagatggggtcttgctgtgtcgtccaggctggagtgcagtggcacaatcttggctcactgcaacctccacctcctgggctcaagtgatcctcccacctcaggctcccaagtagctgagactacaggcatgtgccatcacgcccagctaatttttgtatttttttggagtagagatgggattttgctgtgttgcccaggctggtcttgaactcctgggcttaagccatctgtctgcctcaggctcccaaagtgttgggattacaggtgtgagccactgtgcccggcccagccctttttttaagagaaaaacgtatgacatcgttcgatttactgagtgcttatggttttactaaggcagtaaggttttatggataccctatggtaattagatagaattagtgctctgaagtcagctctgtaatatggactcagagtaaacatggcaaagggacacttaaggtctgcattttctctgggaaataaacgtattctttactactctgaatctagtgctgggaaattctaaatccttcttgaggattaaccacttgaagtaaagttttgggtcccaagtaggcttgtgtccctgtctccttctctttacttttcagatgtttcttcctagagactgaggtatattttacttttacagatgaagaaggaagcctcggctgtgtttgtggcttttgtgggtgagcaacatcacttgcaaagataagatgagcatagcaaaactaggctttcaaaataatttttaaaaatttcttagtgattagaaaaggaaaactcttcccttgtctctgttaagaaacgtttttcgacttttttcctttcttaatggatcttttattggcacttctcttccttttgcagaatcttacttaaaagtcactacgttacattacagcaaacagcttagctaatttttatccagatgggccccggttacaggattgtacactattgcgaatttcttacaggaaagtgaacatcaagtaattattccaaatagagttctcttaagaacgtgagttacttaaaaatgtctaaggatgaagtcacttctgaatataacttcactcaagagaacaaataagcaaactgcatttagcataacatggtaaattagctttaactctccttgatgtttgaacatttgtcgctgttaactactgtttcacttttcaaatagtcagggcttagtttgcttctgtaaggataaagggaaaatacgccttcactgagtcataaatatttttgtggctaacttttgcacagagaaaagaggcctctaagaaggtacccagtgaatttttttttcggggcagggagagaatatgtcattttttggtttgttgttgttgttgtcattgttttgctttgttgtttttactctgaactgaactgtatcttgacagcacttttgaattaagagcattactcttattgttctctactacctggacgccacctccctgttgccatagtgttaaggatcatgctccgaggtggggtgaggcagaatggggccaagatcagaaagttacattaagctacatcaggtttatacaagcataaaaccaaatttttggagcagtccccagaatacaacctggtttagccacacctaaaggttgctcttgaatattccttgagaatccacatccctagaatgctgggtttcaatgggccctttatgtacctatcatggtgtcatttctgagcatttctaaatattccttcatgtcttactgacagtttttcttgaataaatcttaggaatattagtgccattatcagtattttgtttggtctgttcacaccacaaataactacccaggtctgctacttgcccctatttctctacctgctaatgaaaatgcttttgaaagtttgagtaacagtattggagtgtgcacagtggtattggtaggttctgtactcatccttaaccacttgttttcatcctttgtgagcttgaagtttctccaaaaaatttatcacaaaacttatcagacatagttaatacactcagagagagaatcactgaaaaagtagatgtagtttaacaaacccagtgccttttttttacccatgaatacatatttgtcaactaaacctcattttgcaacttgttccactactcgaatggtaacaaacttttggtttcccaatagatttggaagatgttgcttttgaaagtaggaaatagatggctttagaagatggaagaatattttgtttgaagtgggagcgtggtatgtccttagctgtctgtgaaatgcagctgaagatgggtgtgggccttcatctgcatttcccatcttcagtttgaggaggtagttacccttctaaccacttaagaactgcatggtacatgctgttttatttacagggcaaaactgtgctcccgtagtttccctggtgcttgccttcacgttaacacagtgtcatcgtttggcagtgtttatgtgccagggtccatgttagaaggaggaaaggtatagcgaagttaaagggtgcagttggcctcccacctttagttttgtaagtgcctttaaagtttgatttttgtaggttgatcataaggaagtgataagtatgttaggttatttgtggtttgagctaattttagtctctttttacagcttgctttgtatcctttgccattaaaacatgctttctagaaagacaacttttgaatgtaggacacagtctatattctatacttggctacatttcaaaaaatattttctcagtactttggaagttggacagttggaagcatagtgacagtatttaaaaatctttgattccggccgggcatggtggctcacgcctgtaatcccagcactttgggaggccgaggtgggtggatcacttgaggtccggagttcaggaccagcctgaccaacatggtgaaaccctgtctctactaaaaatacaaaattagccgagcgtggtggtacatgcctgtaatcccagctactcaggaggctgaggcaggagaatcgcttgaatctgggaggcggaggttgcattgagccgagatcataccattgcactacagcctgggggacaagagtgaaactctgtctcaaaaaaaaaaaaaaaattaagtgatttctttgctttgtgacacttctacttttccagcaagtaaattatattctttcatacaggtatgaaattcttgttccaagctagtggttaaaaaggcacagttgatattagaggatttgtaaaagattatgaccacgcctgcaatgtactgaagcaaggctttgctgggctgtgtataggaaaccttccccagcctgtgcccttgcttgatagaacattttgctcctaagggtaggtgcctgtatctgtctccagtactggttagtttcacacagaacagttgtgtttcagagctttagtctcaagctgccctgctcccctgaagcagccaccctgagcatgtgcactcacaggaggggacatgtgaggtcatggaagaagacgactcaggaagaagaagacttgggtttgggttctgactctgcctttgactgttgtgggattttgaggagttgcatacaggatctgtaaaatgtagtcattagactagactagacagccatatagcattacctagatgtaactttctacaaagacatggtcacaggagaagaccagagggtggggtgatctttctggaaaaattggggcttcatgccttactcatgctagatatggtagcattatatggctgtgcctgatccccctaatctaaaagtgggacagaactttaaaatttcatattaactcaaattaaaacttgaaaaaaacccattatttccttaaaaataataaaatgccctgtgggggcataagtcacattatattttaaaattcctgaatgccacatggatgaatgtagttccttttgaaattcttcttttgtctaaagaggaatgttggattttgtaattggactaaaaaatcttccatttgagagagaaacagtctgctgcatgttctacccttgttcaggataaaacccactaatagctaacatttattgaattctgtgttgtgcctcaggcactgtgcaaagtcctttacatgcaatgctgtttattatatactgtcaattggtctataacagcaggaaatgtttcaggaggacaatgaggtcccagaccctcagtcttctcctgtgtcctggattcagcttcacaatagcactatggcagtgtggccactgcttcagcttccacatacatggctgtgaagagagacaggggattgtgctaagcctccccgatttattaggacataggaggagagagtttgtagtttttgacctttgcctagttttctaacctctttcctagatgtcacaaattggccacccacagtcatattttgcttgcttcacgcaatgctttttaaaaaagagaagagtttaatttgtgccattgtttataaatgaatcaggagaaatgacatgcaactctggattctggcctctcttgaaaaatctgaaaatcacaccgtctgagcttacactggcagtggtctgctggactgagggacacaactccttttggatgtacatgtgtgcgttgcagagtttaccacagtcccacagtgggtcacactgtccttgtcggtgtacactacctagcacttgagtttgcaacccctaccccaagctgagttttctcgtcaagcttgatgttaatgttatgtgatgcttggccttgtaggtatttggtatattatcgttagataaaattgaagcaaagggctaaagggttggtggcctgagggagtgcccttgacagtaaagtctaggataaaatcattggccaggtactccttcccttcccgcccttcctcttttctctttatcctcagcctccttctgctattttgaggaagttagaagccaccaccattttttcccacctcaggcaactgagtgtggctgtatttctgtcccatgttcagttatttccaggaactatttttgatgaccaacttgaagttacattgggtgggcctaatgggggctgataaaagaatgaggtgaccaaatatgcttgcactgagacggctacgaagtaaggtttttaatgacttgctttgtgacttggtcaggagtgataccatttgtcatgtgtccaacttcatgactaaatggttgctctaccttatcctcatagctataataaaataaaataaatacatacattgcagggaggaatgtatcttgttaaaggtctctcccttttagcaacaaaagtacatattatgttgtagaacatgctttttctttgatccttcttgaacacctattactctatagaggtatgttgtgtatggcaaattagaacaagcaatagataaggatgattctttaccattataacccagtcaaggtctttgtcctaagttttgtacctttctccagagggaaaggtatttgtatttatttatttatttttgaggcagagttttgctcttgttgcccaggctggggtgcaatggcacgatctcagctcactgtaacatccgcctcccgagttcaagtgattctcctgcctcagcctcccgagtagctgggattacaggtgcctgccacgatgcccggctaatttttttttttttttttgtatttttagtagagatggggtttcatcatgttggccaggctggtcttgaactcctgacctcaggtgatccatccacctcggcctcccaaagtgttgggattacaggcatcagccactgcctccggccaggtatttgtatttttagtctctatgccttaccgtctcagatcaggaggatttggtgatttatcgaatgtgggggaaggggaagaagaggaaacgggaggaatgttccagattagggaaatagctagatggaagatgcagcccctcatcaaggtggggacacaggaaaaggaacgtgtgcaaagaagatggtgatctggttgtgaccatgttgttagaggacgtccagggaagcatctggtaggtggtggggtgtttaaatatagaacattcggagaatgctccgaagcttcagagaacccttcccaaaaggacaaaaccagctcagtgttttagcactccgggatcatatggcatgacagcatggctgctttatacttttttgtgtatgtgaaattaaaaccaaccactcaggaccaatttctctgaagctttttgtcaatctttcatttgcttttctcgtctagattgtaagctccttgcagccagtgtctgttgattcagtcattcaaaaaataatacatgaacagctactaggtaccaggctctgtgctgggcagttgggatatgtggtgaggaagacaaacttggtccctgcccttaggaagttcagtagtccagcagacaaagtggctgaataaagataatctcagttcacagtgataagagctcttacaggcctaggctccaggtgctgtggggatgctcaggaaaaggtatctaattgggattgggagcaggcaaaacaaataaaggatagtgtataaaggtaatatctagttgaagttctgaagggcaaggaggagtgagcctgtatattctctgagtctctccctaatctgggattgacttcttgtccgtctctgttcatattaagtgtcacctaggcttgaaagggtgagatcatatttcacttccttcctctttggtcttaacctttctctgctaccccctcacacaatgcatatgcattattctcttattgtatatatttttcctctcttccttttcatgtttcctctgccattacttttaacctcgactgccatatggcctctaaacgcttccagaagggtagcctagtggaggttattccatcatggccttgagctcatgcgaccagatagtgaaggcatctgtgtaggtgtcttctccaggagggtgatatttgtttcattgtaaattttgtagccctagaacaccaacaacagtgcacagtaattagtaggcaggcagtacaggattcattgaagtgaagtgataacttttatccaagtatgtatgcagataatctttgatttgtacaaaaaaaattatattttaatatgtaaagattttttaaaagaatcttcaagttttagccttcccactaggaatatattgaaaacatgtgcctagttcactgacttgcagctgccactatgagaataaaggtctcatttagttgttgtgaattttaagggatattttcaatgatgttggctggtttatcccattatgtggtctttttttttttttttttttttttttgaggtggagtctcgctctgtcacccaggctggagtgcagtggcgcaatctcgactcactgcaacctccgcctcccgggttcaagcgattctgctgtctcagcctcctaagtagctgggattacaggcgcctgccactacgcccagctaatttttggtatttttggtagagaagggtttcaccatgttggtcaggctggtctcgaactcctgacctcatgatccactcacttcagcctcccaaagtgctgggattacaggcgtgagccaccatgcccagcctatgtgctcttattagcaattctcagtacacagatagctttgagtgattctttcaagtcaagtaccttattaaaaaactcaagtgtactgataattatcttacttttaaatggctaagtgataagactgaatttttaggtactgtaacacttcagattacagattctgatatttttatggttatttatatttatttatttttgagatggagttttgctcttgctgcctaggctggagtgcaatggcacgatctcggctcactgcaacctccgcctcccaggttcaagcgattctcctgcctcagcctcctgagtagctgggattacagtcacccgccactacagccggctaatttttgttatttttaatagagacaatgtttcaccatgttggccagggtggtctcgcacttctgacctctggcgatccgcccgcctcggcctcccaaagtgctgggattacaggcgtgagccaccgcacctggcctggttacttaaatttaaatacaaaaattatgttgattaattctgaatgatttcctgattgctccccgtttaccattcacacatttattaaattcttcgcttgccatatagaagcagtctctctgccatatatgccatatagataacagaactagctgtctgcaaaccactgaaattgtgaaaacatctccccttttttcctgtttctaattctagctatgaggattatatacagaagtagtcctggatttgatttttttttttttttgatgattgttttttgatagttgttgactacaaatcatttaaacgtctgaaaggggaaaggttttccttaaaaatggatgacaaaggagaataaaaaggtattttgactatttttttgaatgatgagttttttttttctctttcttgttttcttttggagtcatttatgtgtcactgagtggataccatggaacatgtggcagaagtagatatatggggtaaaagaaccatagttcataagctccttgacagaatcactgaagtgtagccgttatatggccactgtcgcagggggaggcagcagttttgaagaaggggatgagtaataatgagtgataaaaaggcatcctggatagaagaccaaactctgcagaagaccccagtttgattatgcttttgttttctgatttgcggaggagagtgaaaatgcctgaggggtgcgggggagcacatagggtgtatgtgtgtgtgtgtgcgcgtgcagattctctctttcactgtatgtatttgtatgcatgtatgtatcttaggacttaagctttctagtcaataaattgccatagtggggaattgcttaattgcttgccttctgttgttgtatttaatttaattttatttttaatgatttttttggtggggtacagggtcttaactatgttgtccaggctggtcttgaactcctaaactcaagtgatcctcccgcctcgggctcccaaaatgctgggattacaggtgtgagccaccatgcccagcttagttgtattttaaatgggcctgtttgcagcattccctactccccttagtttacctggctcacaacctgtctttccatatcaaggcttctgtcacccctggcccatgtcagtgcatttgggcagcccacccagcatcatcacctcatgtcccagggaacttcctgttcctctcttccagctatttccttccctggcagttgagatagtctctacctttgacctactgttaagctcagaccttctgctctctagttacagcctctgtgctgccagattccctcgctcagttgctttctctagtttgggttttctcctttattcagatttccagctgtttctctcctccccccaccgcagcctcctcacttccctccttatgcatctgagactgtggtcagtcactttagatgctgcctctccactgtacttgtgtccatcttcttacctaccacctctagccctggagcaggctcttcccctgtctttgtcttcctgggcccaggctcctaagcgctgctggaaaaaaaatcccccagtattgagcccctagaaatccagtctttaatcccaaatctgtctcccccagcatctggccatcagatctaaagcttacctgccatcctttccacctcatttctctcacaggggaaaaggagcctttgctcctagagtctgcgctcctgaccccttcccatctcacctgttcaaggcatcttgcaataaggggttggtgactctcgaggaatggatcccaggccctccctattatcatcttatgtatgccagttcaacgttctcagcttcctccagccgagacggcccctccagccactgctttatactctccttctctggttgaaatttttgaagtaaataggtcactctgcccatcgttcatcttccagtcactctgtgtgtttatcttccagggaagtgaggctctatgctaccaagccactgaaataatttttttttttttccagactgagtcttgctctgtcacccaggctggagtgcagtgccgcagtcttggctcactgcaacctctgcctcccggcttcaggcgattctcctgccccagcctcctgagtagctgggattacaggtgcctgtcatcacgcctggctaattttttgtatttttggtagagatggggcttcaccatgttggccaggcttgttggcatgttgaccatgttggccaggctagcctcaagtgatccacccgtcagcctcccaaagtgctgagattacaggtgtgagccaccgcacctggcctgaaataattcttgacaagatctgcttccttgttactaatacagtggatattttgcatcctaattttaatgcagttcagtgtggtagacctgtatttgcatattgaatattcccttccctgttttaataactctattttttccttttcttttatatctcctgcttctctagctagtcctagaccttactcatcggtgtcttctctgtttgttcctcaacttgaggagttcctacagggtttacccaatctgctgctttcatttagcccttttgttctttttgagccatctcattcactcacccaggatgtagcatcggcccttgaattcagtgtgcacacatacactgtgcactatgggacagccttcagaggcactttgttcctgaaattgtggtggtctttgcctctcatggagccttgcatatgctgtttcctctgcctggaatatcctaccttttacttaactgattctcgttcttctttccagtcacattttgtacatttcttctgggaagctttctctgatttcccctttccacaggtccaagttaactgccttgtctaggtcctcccatggccctctgaaggcctcctttcatagcaccatgtctgagtatactgtaataacacgcattgctctgtaatagcctgtttacttacctattgccaagtaatctatcaagtcttataaagggcggggctgcttttgttctagtcatttgtatctcttagtacccaatatagtgtttggcatatagaaaatacccaacaaggccagtcgcagtggctcatacctgtaatccgagcactttggtaggctgaggtgggcggatcacttgaggtcaggagtttgagaccagcctggccaacatggtgaaaccctgtctctactaaaaatacaaaaattagccaggcgtggtggcgggtgcctgtagtcccagctacttgggaggctgaggcaggagaatcacttgaactggggaggtggaggttgcagtgagctgagatcactccactgcactccagcctgggtgacagagtgagactccatcttaaaaaaaaaaaagactccatcttaaaaaaaaaaaaaaagaaaaaagaaagaaaatacccaataagtagttcctgaatgaatagatgagaatgctgtttagaaggttcatgaattggaaaccgtgattgctagggaggctttgagttgatggtattgtgttgaaccatgtgttacccaggatcaatttagattttacactttgttttctctgttcctttttatagtaattttctgtatgtggtgttttccccccatgagattgtataccatttctcagcgagaactgtgtgtaatgcttggtggctccctcatggtgccttgcatggaattggacttcgtttcagtggatctgatcccagttatgttaatgctcgatggagctaagtcttatctcgaagcagtccatgtcttcatcagctggccctgcctccatgccctgcacagaccatgccactctggagaggtagtttccctgtggcttattagtcttatgttccagtgtgctggccaagtatgagagacatcagtggtatgagagagtctctctcattcaaacttcgtaggttttgtagctgggactgaccagtgctgacaggaaatagaggcatttattaaaagccagagatttttcaagttgcaggaagcaaagctcttgttagctatgattttgtggtgggtttggtagtccaatataaaagtaaaaactggatgacaatgggaggagcatgcttgggtctccaaagttagatcatttttcctaagtaatttgtctttaaacttttactggtttggaatttcctgagattttgatcttgccagaaagtttatagcaaaagttctgagcagatgacacttttgcgtctgaaaccaaatcattgtttttgtttttaacttttttcttaatatattatccttagttcagccctgaagattattctgttatttgtggatctcaactttccccccatctcctggatctttgtgaaatgaatggtattaattgaatagagaaggaagatataaacataaacttagtcaaaaacttgttcttgactaggcaagttgggctttatagctttgagctgatgacatgtctattcttgtgaaaaagggatttttagtgttggtttggcttcttgttatatttgatttattattattatcattatcattatttttgagacagagtcttgctctgtcgcccaggctggagtgcagtggctcaatctcggctcagtgcaacctccgcctcccaggttcaagcgattctcgtgcctcagcctctggagtagctgggattacaggcgggtgccactacacctggctaatatttgtatttttagtagagacaggtttcaccatgttggctaggctggtcttgaactcctgacctcaggtgatccacctgccttggcctcccaaagtgctgggattacaggccttagccactgtgcctggctgattttttttttttttttttttttaggtttgttttaactggaactttacgtgaatgtaattgaatttagaataaaagcacttaatttcacagtgtgcagtgaactttctgttacttattttaacagtaaaaccccttgcagtaaatgacttggagcaaagattgcttttttaaaaaatgttttaatttgtttttcttttcttgagatggagtcttgctctgtcaccaggctggagtatggtggcgcgatcttggctcactgcagcctccccgcctcctaggttcaagcgaatctcctgcctcagcctcctgagtagctgggactacaggcacatgccaccatgcccagctaatttttgtatttttagtagagacagggtttcaccatgttggtcaggatggtcttgatctcttgaccccgtgatccaccctcctcggcctcccaaagtgctgggattacaactgctgggattacaagtgctgggattacaagcgtgagccaccacgcctggccaattttttttttttttttctttttgagacagagtttcactctgtcacccaggctggagtgcagtgtcacagtcaaaactcactggcagccttaacctcctgggctcgaatgatcctcctgcctcagcctcccaagtaactgagactacaggcatgtaccactgtgcccagctaattgtttttttattttttattttttgtagggacagggtctcgctattttgcccaggctagtctacaactcttgggctcaagcagtcctcctgccttgacctcccaaaatgttgggattacagggacaagccactgcacctggccaaggattgttttttaagtgaactgagacccagccttattagtggtcccagagcagacctgggacctgaagggaacccttttcttctggtccagcgtctttcctctgatgggctactttcctggagcctttgattgcctgtcatcagagtaactgagtttgaacagagtaggtagttcctctccagaccaccacactcaccagctttcattctgcttctctcgtttagactgtggttctgaatcctcagttctatttactgagtgtttttaaacataaaaatgccttttaatgagattgaaggccagaggtgggacagttgaggacaaagtagaaataaaaccttcaaggcggggttgttggtgggagtctttttttgtttgtttgttttttgagactgagtctcgctctgtcacccaggctggagtgcagtggcacaatctcagctcactgcaacctccgcctcccgagttcaagctattctcctgcctcagcctccttagtagctgggatttcaggctcccgccaccatgcccagctaatttttgtatttttggtagaaacggggtttcaccatgttggccaggctggtctcaaactcctgacctcaggtgatctgtctgcctcagcctcccaaagtgctgggattacaggcgtgagccactgtgcctggcagggagtcttatagaagctgtcgtggacaatgtgggaagtagtgagcctttgtattccagtatgctgggctccactgtgcttgctctggcccccggtcgctctctgtgtgttattgagtccccatccacggccatactcttcgtcctgcttctctccttaccatcctctccccgctagtggtaccacggctaccactagcaattactgacatgtgggatcttagggctacttccctataaggctgcagggcatgtggtgttggctacgcgcatggtaaccatggtagccctgtggttctccacatgtgcgccttgtgacctgggattggctgcagactagtaataaactgcgtcttctggtatggaatctgtctgtagttgtactttctacctctgtatttaaggggagatctgtaacctaccaatgccagttgaagaggatggatgatagagatgttaacaaacagctgaaaaactaactacaatggcctgcaaaatagaacagcaggtttttgtggcaaaactttgtgtccatgagtttgttttttaaatatcctcatataatctgttttaaatcgagaggctttgggtaaaagccatggctagtcttacatgtcatggagtacctagcttgtgaggttcacagtttattatttacagagtgtccccttaaatcttctttgggtcggttcagcgaatgttgctcagatggacttttttggctgacatagagtcaaaatggtaatcaagcatgaaagtacagacagtccttaacgcacaaatgtgtcatgcttgaaaagttggaaagttggttctctggagctctgattgtattgtcctgtagaatccgtgttgtgaatggtggttaaatcccaaatgagtccgtagaacctatataatctgcaatatacctgcagtattccaattaatatgtaattcccccatagaactatgttaatgatttgtatgtatggtatttaatattatacataataatgattgtatgaataaaaaacattctgggctccatgtggatgatggggtgtgtgtgtgtgtctgtctatgtgtgggtgggtgtgtgttcatagatcccttttcctgcaatcctggcactggaattggttttatcatttccaattaagtttcattcccatgaattttggagtacagactgggtccaggtatgcagggcatagattagagccctgagaaataggattaggctggaattgctgggttggagatcagtagcttccaggaacactttttgggcctggctgtcttcattatccccttttgttttctcctggggtctgcaggtattgccctgttttgttcctctaatatcactttttttttttttctgcttttgaccagggtttttgcctctggtctacaactgaatatcctatcagactctcctgattttgaaataaatatatagtttttttgaggtgttctagcgaatttctaaatctaaatgttgtggcagagttattacatactaattttgctatgagaggttgtagaatcccagatgactaatcttgtaaaccatacacgcatttccatctaattctccattgtatatcatgttgcagaaaataacagcctctagagtttacattgcctcctttgactatatttcttatttaagattagttttcagataagaccttttcatggcagtacataactgtacagagggcttccaacttgtcttgggagctctcatctctgggagacatcacattacccactgccccctgccccccgcccccagcctggatgcactcagcctgtaccccatttctgtcctcagccaaacactgctgaaatgcaagagctttcaattgctagccagtgaagatgcagactaagggatttccatgtagaagcccgctcttttcagctggctcgtcgagagctggaggccccttgcttgttcacatgaggctttttgtccctgacttggtggctgctgtttcacttctcagcagaaagggacacccttgcccccccccagaaaggaagatttgatgtaccacttccgaaaggttcagtcgggcatcactgtaaccaagaagataggtcaggtgaggctggaggtggaacagggctgctcgctagaactccagattgttccacaagtgccttctggcagagaatgatggaagcttccgtgatttttttttctccttaatagttatgagcacagaagaggagcagattgtctggctatagaagctgtcttattttttatttttgtttttgagatggagtctttctctcttgcccaggctaaagtgcaatggcgcgatctcggctcactgcaacctccgcctcccgagttcaagcgattctcctgcctcagcctcctgagtagctgggaattacaggcatgcgccaccatgccagactgatttttgtattagagacagggtttcaccatgttggtcagtctggtttcgaactcctgacctcaagatctgcccacctcagcctcccaaagtgttgggattacaggtgttagccactgcacccggccgaagctgtcatattaaatagcactttctgcttttagcaaatttaatccaaatgagactttagattttcttgctctgacttaccagcagttccttgaaacacatttaattatttttgccagaaaatcactcaagcacttacgccatttttttaccgtgaaaatatgctgcattattttaaaatatattagaagtcagtaaccataagattttatatgttttctaatgtattctgtaagctttctgctgcttttgtttggaaggtgtattttgtaacgtagaggactgctttatctgcttgtaagcttgatttttgtttttactgtaatttttttttcttttgctgtattgagaaatacattgagtaattataaagtcagtggcatgtttataagttaatatttgtatctattccttagttactctaactcaaaacctaaagtaatcttcaactctaatttactctgacatccagttgactgccaagtcctccaacttaatccttatccttttttttttaaagagatgcagtcttgctttgtcacccaggctggagtgcagtggtgcaatcatagcttactgtaacctcaaattcctgggctcaaatgatcctcccacgtcagcctctggagtagctggggctacaggctcttgctaccatgcccagctaactttttatttttattttttatagagacagagtctcactgttgctcaggctggccttgaactcctgccttcaggcggaactcctgccttcaggcggtcctcctgcattggcctcccaaagtgctggaattacaggcccaattttattcttgggatgtatgtctgaaactctttccttcacttccttcccaagccttagttcaggcccttctcatctgtggtcttcaaagtcgccttcagctggttcaggtccttcctttctgctgtatctttcatgggaggacatgttatgtatcactgtcctacttgaaaacttccattccccattgatgagggtgttacctccagattcctaacacaggtgctgaaggcatgcctggataaaggcactcccttgatctcctggccaggtccccgtacacctgcagcgcatgctccacattctgtctttactgatgctgtgtcttctgcctgcggagccacccaccattctattcacagcccctgcctcagcggagcacgtgcctccctcttcctacactgagctgtcctttctattgaatcccctcttttttgtagtatgggaaatattttattatgaatactcttttctctgttgcctccgtgaccacgttaactttgccctaattcgccttaggactccatctgcttaggggaaagttaggatttggttacagaaagcaagctgctagaaagaacagtgtttagcttctgacaggcaaaataggattttgcaacatgcttttcctttttaatgcttagacattttatatgaattaatatttttatttggttgcttatacattactttctttttagctagaatgtgaaccctataggaacatggggattgcctttcacatctttgtatcctcagtacctaatgttcagtcaccctgtggtcttgtgtcgtatatacatttagccttccttaattaaaccatatgtactggtccccgtcccccacccccaaatagagagaaagaaattccttgaatactacattgccagtatcaaaccacaccttgatatcctctggggaaagggaggtatcagttgaaaagagaaaagaggttaaaatctaggcattaaaatgtgtaaggcttagatgctggcaatttaaggtatgttttcctgaggttaattttgattgtgtgcaaattttacctcatatctaactgtaggatttagtcaccacataagatgggatacctccataaatccttcagaaatgtttgtgaaattaaataaagccttattgaagactcagctcttgagagtcatctacctacctaacagttattcttgaacagaagagtcttacttttccctataaggcagtgtgatagccatctgtatattcatataatttatgttggcgcttacttcatttaaaaatgtattccgtgaatgcagttgccaggcggtgtgctgatcagaaacgtgtaccaatggcctcttttataattataagaggaagaccaacctgaaacagtcacacaaatgattaattttaattgtggaggagtgctgggaaagaaaaataaaagatgcaatgcaagtgtttacaaaggagctttgagcttgtttgaagtggtccttgggcacttaagcaaggcttaaagaatgatgtgattagaagtggcttagcaattctaaagaacacagggaaggcgtgtggccagaacattggtccctagagcacatcgcctcctgacataccatttccttaagttaatgttttaccactatacataggccctcccctttgtttacccagatttttttaattttaaggatgtttttaataacttagaatcctgtaatttgttgaacagtcctgtattccctttacttatattccttgagattttataaaatattttttacatgtcccaagtcttgattatatctttttacctcttgttaagaaatacttacttttctatttttatgctatatttcatgtttactgtagaaaacaaaaaaagtaaaatttttctttattcctatcactgcagcttataagcactctaaacattttgatctatattttgccaatcatatattttagttaaaattgttgttgacataattgtagattcctgtgcagttgaaagaaataatacagagctgagcgcggtggctcacgcctgtaatcccagcactttgggaggccgaggcaggcagatcatgaggtcaggagtttgagaccagactggccaacatggcgaaaccctgtctctactaaaaatacaaaaattagctgggtgtggtggcgggcacctgtaatcccagctagttgggaggctgaggcaggagaatcgtttgaactccggaggcagaggttgcagtgagccgagatggtaccattccactccagcctgggcaacaagagcaagactgcatctcaaaaataataataataataataaataaactttaaaaataaaacagagagatcccatgtgcgctttgcctagttcccccatccactgcccataacattttgcagaactgcagtacagtatcacaaccacaatactgacattgatacagtctgctcatcttattcatatttccccagtgttactcgtatccacgtgtgtatgcattgtgttttcaatactcttttattataaagctgtttttaatgtgattcaattctaggttgttttgttctgccctcaaaaagcattccctctcctaatcatatctccgtcatacccttgtatgttttctttaaacctgttttaagaaagcagctacctgtaagagaaatgagattgaaaacagaattgccaatctgcttgtactttataagcctgttgattgtttagatacggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgcctctctggggaacaaataaccgaaaagatactcagcaccctggttggtacataggtggtcagttgatttatacttcctggttttcagtgttgcttgaattttctaaatggaaacacagtacctttataatcagaaaacaatcccgagttttgatttgagggtgttgtaaaaagttaaaaaaaaaaaaacagaaatgtgaaaaggaagttgtgttagagtatttggagttgagaaagcatgaaaaggacagaagagaagctggttgtcaggttgcatggggtagctacaagcacactgaccagaaagtcagctggaaaaaaaatgtagaaacaggagataaaacggccaaggggctatacaagcaaacagcaaggacctgagaagaaaaactagttaggtgtgactgtcagagtgatgtgtacagtgtgatcctttctgtgtaaaaacaagcagtaagaattcgctgtttacgtttgcgtgtgtttggagaagagtggggaagagtaggcactgccagactgtgaacactggttaggttattgttatatctttgtattatatacactggacatgttatttgtataatatgagaagaaattttataaatcattaaatcttttggcatttaggaacatttgtgttttctaatagttgcttctatactattatctttattatatgcccttcatcttctcagtgtttggctgttgttgtgattcccttttgtgagcagtgttgaagttagctaatattcatttcttctcccttctttcaccctcctccagagtctgatttgaagtattcctagctgctacctataaaagcaataagcaagattgttttacttttcacaaactcgtcctgttctgtgcctctgcctcggacatagctgtagtatagagtgttgtctcccttacatccttctatcttagacctactagtaaatattaatgctcactctaagttcttctcaattcttttttttttttttttttttttttttgagaaagagtttcgctcttgttgcccaggctggagtgcaacggcacgatttcggctcaccgcaacctccaccttctgggtttaagcgactctcctgcctcagcctcctgagtagctgggattacagtcacgtgccaccacccctggcaaattttgtatttttagtagagacaaggtttcttccatgttggccaggctggtctcaaactcccgacctcaggtgatccacctgcctcagccttccaaagtgctgggattccaggcgtgagccaccgcgcccagcctcttctctcaattcttcctgaagctctttctgcactagattcctcaggaagggcttgtgggaacaatcttctgtgaatcaacagtacatattcataatagtttgtcagcagcctattattttaaggccatttggtctgtatataaaaatgtttggatcacattttctttctttaaggtaaatatgttattctgttgtcttctggtataaagcattgctgtaaatgtttgacagtctaattatcttttgcttataagtgacttagggttttttgtctatgtgcccaaaggattttttccctctttctctctttttttttttttttttttttttttaaacagacaggatctcaccctgttgcccaggctttagtgcagtgaggcagtcagagcttactgaagttttgaactcctgggcttgaggaacaaaggatttttttaaccttttaattcaaagtctcatcatttatgcaaccatgtcttggtgttggctgttttgggttgttctccctcaaaaatccatgtgctctttcaatatgtagttttaaatcttttttttttaatttcaggaaaatcttgaattagagttttccgtttttcgtctggtacattgcttgggtttccttcttcaggaactcagcctgttatgtgtatgtttgatcttctttgcctgtcgtctgtttctttcacttcctctcacttttttaaacttcatttattaaaaaaaaatttttttttcgagacagagtttcgctcttgttgcccaggctggagtgcaatggcgtgatctcggctcactgcaacctccgcctcccaggttcaagtgattctcctgcctcagtctcccaagtagctgggattacaggcatgcgccaccacgcccagctaattttttgtatttttagtagagacagggtttctccatgttggtcaggctggtcttgaactcctgacctcgtgatctgcccgcctcagcctcccaaagtgctgggattacaggcgtgagccactgtgcccagccttattaaaaattttaaaaacatacatttaaacttaacagaaaaattatgagagagaagggggtggtgccaggcttttttaaacaaccagctcttacatgaactcatagagtgataactcattaccatgaggacggcatcaagccgttcatgaaggatctggccccgtgacccagacacctcctactaggtccatttttaacattggggatcacatttcaacgtgagatttggagggggcaaaactacaaaccatgtcactcagggattggaggagcaagtaccacctatactttggactcaggtagaaaggcaaaatatccaggaaataagctgctaccgtccagggttcagcagaggtgcccatcagcctgccaagtactcaagagtccagcctctagggagctaatcatcatggtgagctcttcgaggcacagggagctgggaagacagtgcttgccacccctgcctgaatagtgtttgcacagagagttctgttgtgtcttgattgggtcctcctgccactgggaatgctgtggattatactaggtctctatctggcttgtttcagggctccatgtgaaaaccttcttgatatcctagccatccacctgctcagtccctagtttgcaaggaggctgtggggagcctagattctgtgtcagatagaatgtactacattccgtctcaggaatgtaccacatcagaaaacagtgcgacctgcaggagaagtagaggtgaagaggcacattcttccgagaaatgtttctctcaacacccagcattccctggatatcagcaggaaattactcactgctagaaaatgccccatgagccttctgttaaggaggtcaagggagagaacagagaaagttctcaaagttgacttggtcactggtactttcttatgcggttcttattttgtttgccatcgtcatcatcatgctatgtctattttctcaatccaaatccactgctttcaccttggttctttctgaccggtttggcacactcattcagtaaatccttatggagagcccaatgtctgcataattgtgctgtgctgatgaccaagctagacctacgagtgtcggctcctttgagatgtacgggacagctcttctgtcatctcttctgggaagcctctccaggcttggtgaacagtggcaagatgtttaacagttgtacatgtgtcccatgttcctttctaagagcctgggcaaaccagacccggtcgcaggtcatcgtagtatggcgtgagcttcctctctcctttctgaccttttgtgtgatggcaagaacctgcagagtgacacaagcagcaggcttctgaggttgctctagcctcagaatggccgtcccttctccaccctggccctcattgctgaggtttcctttgaagcaacagtgccggaacagactaggggaagcagcttggacatagctgtatgatttattaccacccattgaggccaaccaaagtcggcaaggagaggtagcaggtcagtggtgcctggaagcttcctctttcctttgcaccagatgtgactgctctgcaattactcctaaatttgctactctcgtttttactagccaaccttgatgtttttcccttcttcctgtagaatagacttcccctctgatcagtactttctactcaacactatttgtggccacagtgggaactcattgaggacagggaccatgacattactacctgacccatcaacacttggcataacttgaaatgcaaggacaaaaattggctgcaagtacaatgtggtcttcactctgaaggtgatccttaaaacttggctttggcatcatattgccttaatatacctaggggattgggtaaaaccagttactttaaaagagttttacaattctggccttctagctatcttgtcttcttaaacaagagcacaagatgaatgtatcttagtgaaattttatatggtttgctttgagtaatcttgcgaagattgatttttagcacagtaggaaagacacattctaatagtgatttttttccccgagtttatgtactgctgttgcatgaaaatctgactagatttaatgttcctaaagttctttgttcatcctgatttttgcaggtcctagggaaagctttgttttcctcttaacctaacttagatgttgtcatttcatgagctttggaggaagagtgtatagccaattgtgtaatgtctttaaaggatattatctctgcaatagttgtttataaggcctaagttattcatgtaataatagtggccccggatctgtttctagcaataggtatatggattttggttcctatatagttgtagttgtggctttgagatattgagcaagcccttttaagaaaggatttggcatccctcagccttcaaaagcttctcaaaattgatcatatgttattagcaaaggtttactgcctgcttccattgtatagacaatttattttttatgtattccgttctaagaaggcagatgaccaaaagatcttgcatctgttgcccaaggcttgtgactagagaggaaagagataagaatacttttttaaaatcccattttactaaatatgttgaggaagtggtaagatatattaatttgttgagatttttctgttatgcctattatatgaaataggtactctgaacatggcttcttaattaaatatatttgataaaatacaacttgcttcccctggagtttagaagtcagataactgccatggagagctatgctttctttgttttaaagatctgcttatgaacatgataaacaggaacaatttaatgttttcaatattttcttgtattttactgcaagtttatacacaacataaatatgggggaagggggaaatgtttataccagagccatcctgcccattctttccttacagaaggacaaaggagcagtatttattttaactacaaaaatactattgtaggttttaaaaattccgtatattttgatatcttgtgttcctcttgacctttaatttgctaaatagttgcaaagaatgaaggtaacctgcatcatcttcttaaaaaccaactctatctaattataatagtttgtctatctctgaaaaatagtgatgtgttcattctgaaatcagaactaccggatgcagctgcattttgttactatttgaatttcgggagagggaggaggatgcagcctttcgagctgctgaaatacacaaacacaaagaagacaccaagcatagtagaactgtgttaagctgaccaagccagaagaagcacctattctcagcatagtatgagacgtaaaggcaatataatgggcatagttgaagatggtagaaggaaaatagactctgatggtttaatgttaaatgctttttttaaaaaagtggtattccaatatcgaagaagaagactttctacttttagaagcaataaaggaaattgcagaggaaagggtcaataggttggaatacataaaaattaaaaacttttaaactttttttttttgagacagagtctcactctgtcacccaggctggagtgcaatggtgcaatctcggctcgctacaacctccgcttcctgagttcaagcaattctcctgcctcagcctcccgagtagctgggattacaggcatgggccaccactcctggctaatatttgtatttttagtagagacagggtttcaccatgttgtccaggctgatctcaaactcctgacctcgtgatccgcctgcctcggcctcccaaagtgctgggattacaggcatgagccaccgcgcctggactaaattgtttcagtattaattttttttaaaacaagatcttactgttgcccaggctgaagtacagtggcccaatcatggctaactgcagccttgacttctgggcctcaagggatcctcccacctcagcgtcccgagtagctgggaccacagacatgtaccaccacacccagctacttgttttatttttatttttgtagagatgaggtttcaccatgttgcccaggctggtctcgaactcctgggcccaagcaatcctcctcccttggcctcccaaagtgctggtattacaggtgtaagccattgcgccctgcctgattttttaaatgtgcaaacagataagttggaaaagtgatttccaataaagataaagagttgatggttttaaaatacgtaaagagcttatatgaatgagaaaaacactaacattccaaaagattagaaggcaaaggacagaaagaaacaaatcactatgtctgggaagggacatgaaggagcaggttcccactgggccagcggggctcaaacccactggggacgtccgagagactgcaagggccatgccttcacattgccgtacctgagaagcaaggagctggggtatttatctctttcacactttgggaggctgaggtgggcggatcacctgaggtcaggagttcgagactagcctggccaacacagtgaaaccccgtctctactaaaactagaaataattagctgggtgtggtggcacacacctgtaatcccagctacttggaaggctgaggcatgagaattgcttgagcccaggaggtagaggctgcagtgagcataaattgcaccactgcactccagcctgggtgaaactctgtctcaaaaagtaataataatcatgataaataaaataacattagattgttagcagaagtagccacaggtttctcccacctctctgcaagttgctgagtgtgattcccatcaagaggtacaatgtctttttatttttattttatttattttatttatattgcctatgttgtctaggctggttccaaactcctgagctcaagtgatccttctacgtcagccccccaaagtgttgggattacaggcatcagccactgcacctggcccagatactttttcttgagtaggaatttcgagtcaccctgaacattgcatgccttcgtagtggggaagacaataggaaaccacaggctgtaggctaaaatgggttgtgtttcttgtaacgtcatgacaaggcataacccatcttggcatagtaaatagtaagcactcactgaactgatgattttaaatctttgctgtttattcagcaatatcctaaattagcgctatgttagtggagttgcatctccctcatggattagtctgaaaaagatgagaaatctgtatgtagaccaagttatccttaaactgctcataatgtatgatgcacgtggttttacgtgtacagcctggtaccattgttcttaggcacatttcagtgccagaactcttaatacccaggaagaagcaaaaagaaagatggaggtgcagctagaggttgtggcctttgaacgattcattctgccttaataagagtggtctggctgagctcggtggctcacacctgtaatcccagcactttgggaggccaaggcaggcagatcgcttgagcccaggagttcaagaccagcccaggcagcatagcgagaccccccctccccccgtctctacaaaaaaatagaaacaatgagccaggcatggtggaacgtagtgcgtggtgcctgtagtctcagctacccagttggctgaggtgggaggatcacctgagccctagaagtcgaggcttcagtgagcccttattgtgccactgcactccactctaggtgacagagcgagacaggtcctgtctcgaaaagaaagaagaagaattaaaaaaagtgattagatcccttgtgtttgggacacttgttggcagcagggatggtagcgtttatgagggttgcatgtaacatcgcctagctcagacatctgtttgactgtcttcccccctgaagcgcaggctctgtgagggcaggtcttttgtctttcttgttaatcttcatatgcttagtgcttgccacatagttgatgctcagtcgatatttggatgaattgaagggattaatgcattgaatctgaaccttgctttcttaatgcatatggggagttctttggaaagccacacagaggagcttggttgcctgcttcctctcttccccagattgtctttttattgttgtggcttcactgaagcactctcacttcaaataattttgggcattggtcgtattttattctttgttccttcttcatccttacccctcagatggtatgtagaaaagtacactacatctagaaagtactttataaactcatttggttgataataatacatatgccttttccttggtcctggtagcagaatcttgtgccactcttggaatacaaacgaaattcttaaccaaagccagtttcattttgatgttctattttcctcccattcacactccaaattgtgcaccaaagtatcatcctagttttgtgaggatggttctccatacttcagggtaggagtatcatgtggattcctatgatacctttctccctgggaccatggagggcagcagctggtgattgatagtctgattcccggtgaggaaagctgtgagccttccacttgcagatgtctgccaactacatgtgtccttagtcaactgtaccactgtcctccggcaaacagcagaagcccagggcctgaagttcttaagctgtcattatggaaagcagaaggtaaacaaaacagaagtgaaagtagatttaattttttagactgttctcttacaggaatggttttgtggttctcagcattttaaaaaaaatagtggttccaatatgttttattgacatcaattactgtaagtctgattcattttctgcctattgatttctacccaaggtgaaattcatgacatttaacagaaagcataagtgattttttaaaagcagacactattagggacggtaaaaataagatttaaagtcgggacacttgaaaaagcaatttttatacctttggtaacgattctattctgattctttgtataaataatataaacaaaggctctagaagcttactataatgaagttggtgtgctgtttctaaattctggtttaaggcccaaattcattttatctgcattaacttttttttttttgagagtctcgctctgtcacccaggctagagtgcaatggtatgatctcggctcactgcaacctctgcctcccgggttcaagcgattctcctgcctcagcctcccgagtagctgggattataggtgtgcgccaccacgcccggctaatttttgtatttttagtagagacggggtttcactatgctggtcaggctggtctcaaactcctgaccttgtgatccgcctgcctcggcctcccaaagtgctgggattacaggcgtgagccactgcacccggccgtgttaaaatttttcagtggtagaccactatgtcaatatgttgctttcactgacaacagtattttcttaaagataggataccccatttctagatgaatctcattctagctggaaaataatttttcagttctgaaactacatcaggcctcagggaatcaaaactagctattagccacacacatataaagtggctttgctttataaacgatttagggtcaccatcaatgacaatggtccctttttattgtatttttaagagtttcttatcttaaatggctgcataactgtagagttttaaaaaaattaagtaaatgaccatgttaatgctctattaagcttccaaacaatattgtaatttactttgaagatttttttttattctcaacatcctgcagcttgaccgtttgcctccgtgtctcagtgctgcttattttgaggtgtggactggagtccatctgtcccccttgcctctgaactgctccgttttgtgtttcgtaattcttcatgctgcatcctgggcgcatttctctgtagtagctttcaatttgctcatgctttgactgggcttagtctagcgtttatcctatctcttaaggttttttaaaaaattttcatgattattcatttatttccaggatttctcatttcttcagtcacatctccttgttctggttttacttcttcctgtttttattcataacatcttttttatacacgattccttcatgtatttctaatcttaagtatatttaattgcttatttgattcttttttttttttattgagacagggtcttactctgccaccaggccggagtgcagtgacatagtcatagctcactgcagcctcaactacttggactcaagcgaccttcccacctcagcctcccaggtagctaggaatacaggtgtgagagccgccacacccagctgatttgtcttactatgttgcccaggctggtcttgaattcctgggctcatgtgatctgcccttcttggcctcctgaagtgctgagattataggtgtgaaccactgcacctggccaagtatgtttatttatttattctaatttgagagggagtctcgctctgtcgtgcccaggctgtagtgcagtggcacaatcccagctcactgcaacctctgcctcctgggttcatgcgattctcttgcctcagcctcctgagtacctggggttacagttgcgtgccaccacacctagctaatttttgtgtttttagtacaggcggggttttaccctgttggccaggctggtcttgaacttgtgacctgaagtgatccgcccgccttggcctcccaaagtgctgggattacaggcatgagccaccacgcttggcccaagtatgtttatttttaaagtccccaacaagctatacaataaattgcatatggaatggatttttgttctagttgatttgttggttatcatttgtagaactaactagttgtcttctgtgtttgataccttgcttctaggtcattttgagttgggagccttttgttttgtttttattctcatgctgtttttgagcctagctgtgcctttatggttttctctaaatttaattgaccattgttttatatttggagcagtgggtgtacatcagagtgtgaaagcagccccaccctctccaccagaaggtctccatgccagtttcacgaagcatttttcatgccctcattcctgcccttatcccttgatttgtggggagtttgtaaagcagttgattgttttttttccacgtagttttccaagtgcacataattgttctgttagtgacttgtagctccattatctattaaccttgccccagaccactgtacaagcggacccaacgcttcctccagctgtggcagggacagttacttggtatcctgctgccttttcaatgctgaccagttttgccccttcctcccctcaacccctgtctttcattcaactatcaccaaaccaaaagattctggtttgctttttagtatgtgttcttattcagtacatagtcattttaaaatttaaaccaaaacagacttggtactgattagcttaattttaagctttttctttattattaaacagtgtagtttatcttagcatttcatattaagtatatgatttatttcatattgcttatatgaatgtacacataaatataataaaaatattttcctaaggtttttgtagtaaattatatcgtttcattaactttcatatatagcattgcttttgacctggaagacattgaacctctgatgatttgtatattcctcggagtatactttgttacatagaaattttctcatttataatgagatttgtgattaacaaaatttgttcaacatgcattactttgaagatctggtttctaaaattttatgctagttaccccacccccccttctatatatatctccctattcagcgactactgcaagagttccaggaaatgtacactgtgtgttcacttactgcattttaaatcattgcctttactatatttctgcatttcccttcaatctagctctgtctgtacatttctgaaagccagtagcttccctgaagaaccaggtaacaacccgaacaatcaaattagataaccatttgtagaatggaggttccgggagatcttagaagatgtgatgggtgctaagggactttgtagttccctgaagttccagtgagtaaaaggtacccttggaattttttattccttcagacttttaaaacagagatcactttcaaaaattactctttctgctttgaatccatgttttagtaactattttgacactgtttggtcagaaggctgtgtgggtcaactgcaaataaataaaataaatgtgatttcagtaatttccattttgtaacaagtaattgagaaaataggattggatcagatatttgcttatacacattccctttcaggagcacttctgttctataaagaatgttggtatattgttaaggacacttcaagctttgggaacctttgaagtatccattgattcagttaacaaaattatgttgagtgcctaccctgggcctgggcctgtgttaggaggggacactaagatgagagtccaaagcacttcttctcagactcctggctgctaatgggttgctgcctctacttcttcacttagcagatagctttaaaatgagtaatgcattttaccatggagcccgtaagagacattcacccagttgtggaccgaggagaagggtgttaaacccagattgtgatgtttcacttgatgaagtgcttaatataaacatggaaatatttccgcaaggataaactggcttttatgcctgtgtgttttcaggagaaatagaaatctctaatcaaatattgccagcttttcacccaagtttgactttttgcctaattgagtttgggaggtgtctgaataatggataatgagctttcctgaataaatataaaaattaattaactccaggctctaattcattctgttaccagagttttgtaagcatgttacccctttgtgttcattgggagatcatctgttaccttcttaaatgagtggggaaggatgggaaatgaggaagagctataaaaactattcaggtgaagaaggtttctgcccctccttgccccttttaaaatctccagctcagcagatgctttgtttaaacttgatcaagtgcttgtgaatcttcctagcctagctaaatcataactttggaaggacttgcttttttctctcatgacaatggtttaccacagaaatgattcagatcactttgtgtgcctgatgcctatgtaaaatgatacagtgaaatggaaaccatttacctgtaagctttgggcacacccaagcctgcttcaggagcacatgatcaggcgtgcactctgggagagccgtacacatttgacatctatgatgtgtggcgttttattctatcacatttctgaaatctacactaagagaaaggaggctcttaaaaaaccactgaggtgtggactgggggaaggagagatccgtaaagaacctgtttgttacctgttgatactatttcccattggtaaaatttctaatttagtgtgatccagccctgaaatgctgaggcacacactgaatgactcctgacatctttagtgtttttgttcaggggactcttctgggaatctgtttcatggcaagtttattattcccttttggtttggctcatcagtttacccagcagtcatcttaatcggttttaaaggcttttattttattttgttttctctgtggaaattttacacattcagtagattagaagtagttatttaatctttggttagcataataaaagatcttctagggacattttttgcttgcagtggaaggctagttaaatgtgttcattagtcatgaatctgctttttctatagctgttggaaacgtagctcccctgtgatacagttgtagaatacagaaatctcgttttgctgttacggtacggtagtctacttactttcttccaaaccattaatgttatagttacctttaattgcgtaggtcctatcacccctcaattttaagactctaagcctggcattttatcttacaaaatgaaatataaagacttgtactcagagtatgtgtgtgttttccatataccattctaaagtagagaaagatgagggattcgccagaaactgatttctaataaattatccagaaactgaccccttctcacctcttctgttactgtcactgtggtttcagccacagcatcctttgctgcattgttaccttagtttcctgactgtatccttccttacaccattgatccctgcaatcccatctgcgcgtagcagccagaagggatccacttactgctgtgatcagaaatcctcagccaggtgcagtggctcatgcctgtaatctcagcactatgggaggctgagactggagaattatttgagcccaggagtttgagaccagcctcaaactgggtaatataatgagacctcatctctacaaacaggaaaaaaaaaattttttttttttttttaactagccaggtatagtgctaatatacctgttctgggatccagcatgctctccctgacctgcagcttcatctccaccactttgcccctcactcccaccacaatggctttcttctcttcctcagacatgccgtgcgtcctcctacctggaatattcccctccaaacattcccatggctcactccctcaccttcatcagatctctgttccagtgtcacttttactggaaggtcttttgtgaccatcctacttattataaaaaaataatctgcccaaccttctccttttatttcctctacttgatttttcaatttagtacttatcagctgacatatattttgtctctctgtctctctctgtctctcatagaaggtaaattctataaaggaaggaatttttatgtttggttctttgctgtagctccaatattcaaaacagtgcctgacacacagtaggccctttatatttgttgaataaatgttgacactctgatatctaatttttgtctggtgactaatacgaaaactatagagtgataataaaagcattaccttagtagactggaaagggatgagcgctaggatgaactttctgcctggcgatcttgctgaatttaggaggcagattggggttcaaaggaggctgaaatggctaggatttgcagagcagggtactaaggatgagcaggctatgacagaaagaactccagaaatctgcaaagggatcaccttgagtctggctggatacagtgtacactttgtagggtgtctcttcatgagcttggataaagaacaactgttggggagtggataattcccagcactcattcaagcttgcatcggccagaacggagagagacagacctctgtaatacgtaggatatttggtagaaacattcaaccgaaaaccatcagatatgcaaaaagtaataataataagtaaacaatgtgatgcatagctagaagaaaaatcagacattagaagcaagcccagaaatgacagatgataaattagcagataaggacattaaaacagctattataaataacttagcagatttaaagaaaaacaacataatgaggataatggaagaaaaacaaccgaataccatttctaaagaagaaaaatacaatatctgaaatgagaatttagctggataggattaatagtttaggcactgcagaagaaaaaaacagcatctatatgagaatatacccaagggaagtacagagaggaaaaaaatgtggattggggggtgcctcagtgacatatggaacaatattaaacaagtctgcccccaaaatacttgaaggaataaggttcaagttttttccaggtttaatgaaaactataagcctacagattcaagcatttcaacaaaccttcagcaaaataaacaaaaccacagtaggcctggcacactgtctcatgcctgcaatcccagcactttgggagcctgagtcaggaggattgcttgagatctgcttgggcaacatagccagaccctgtctctacaaaaaataaaatgaaataaattagctggatgtggaggtccacacctgtaactctagctagcctggaggctaagaagggaggattgcctgagcccagtagttcaaggctggagtgagctaggactgcatcactgcactccagcctaggcaacagcaagaccacatctctctctctctctctctctctctctcaaaaggcagtgaaataacgacttatttggggaaaaaataaaggcagagaatttgttgccagcagactagcataaaaaaaaggaagtccttgaaacagaagagaaatgataaaagatggaaatttggatatatactaaagaatgaggattgctaaaagtgacatacatagataaatatgaaatatatttttattttaaaatttatttaaagcaaaaataaaaatacatcatatttataacatagaaataaaaaatgtatgataatagcataaaggataagtggacaaatgctgttgtcgtatttttggtaaaatgcactattatttgaaagtagaccatcgtgaattcgatgcatattgtaaaccaaatagaacactaaaaaatgaaaataaagagatatggctaatgtgccaatggtggagataagatagatgcaaaaaaagaaaaacattcaaaagaaggcagagacagaggaaaaaaggaccaaagatcaaatgagtcaaatagaaagcagctaaactagcaatatggcagatttaaatctagccatgtcaatagttatattaaatgtaaatgttctaaatacctgaattaaaggatgaagattgtcagattagattgaaaaagcatgacccaactacatgctgtctgtaagaaattagaaaaagaacaaattaaatccaaagtaagaagaaaggaaatagagtagaagttagtgaagtataaaacaaagagcaaagaaaatcaattaaatgaaaagctggttctttgtaaagatcagtaaaattgataaatttctagctaaactggccaagaaaaaagaaaagacatacaaattaacagtatcaggaagaaaaacagagaattcaaaggagtgtaatgcaaactttatgctagtaaatgcaataagttagatggtatggaaaaaaatgtgaacaatacaaagcagactgtggttgcctttggtggcagtagcggggtgggagtggaaggttgaattgactggaaccagaagcacaagtgaactttttggggtgatggaaatgttttgtatcttggttgcattgatagttaaatggttgtagacattgcttaaaactcactgaacacttaagtgggtatgttttattatttgtaaaatatacctcaaaagcagttttaaaaatgtattcaagtacatacttaagatctttgcattttactctgagtataccttaattttaaaatctgttttttaaaaagtattatgtagataccttttattttcccaatgtctttattaaatgacatctccacgttttgcttcttacctctatttttttttttttatttctctgtctctcaggcatgcacacacacacaccaaaaaaagtacatatgcataatccttttggctgaataaaatcagttgcaactgttatttcggcccttatttgctccgggtaaatattcgttagctgagtggtttatctgtatcagatatttcttacatcttcatccagtcacaccagctggactgaccagattgtttttcacttcaagggcagaatttgtactcactgctgaatgcttccaaatgatacgtagaataacaaatttaagacttagatttttactttttcaggtctttttttttttttctgtgctgtatagcatttccctgaaagcttaatctcatctgtaagtgatgcagtggatgtgttactattggattaatttatttactcttaggtaggtttgtaatctgtcatcatgctgttgtttttttgtgtgggtttgtttttggttttgagacagggtctcactctgctgcccaggctggagaggctagagtgcagtgatgtgtttatgggtcactgcagattcaatctcctgggctcaagtgatcttcctgcctcaaccccttgtgtagatggaagcacaggtgcacgccaccacacccggctatttttttaaatgtattgtagagacgaggcatcatttttttgcccaaggctgatcttgaactcctgggctcaaacaatcctcccacctcggctcccaaagtgctgggattacagatgtgaaccaccactcgagctccatcattctgttattagttgttctctagtatgagtcaaaaactcttacctgcccttttacagttttataaataagtaagcagaatagcagaatgtggacattttttaaatccaaattgaatatgcacatgactcaaggagtcaaatagtaccgtaatcggtttatgataaaatccagtggtttggctgggtgtcgtggctcacacttgtaatcccagcaccttgggaggctgaggcaggtggatcacctgaagtcaggagtttgagaccagtctgacctacatggtgaaactactaaaatacaaaattagctgggcatggtggtgcatgcctgtaatcccagctacttgggaggctgaggcaggagaattgcttcaacccgggaggcagaggttgtggtgagccgatatcgcattatttcagaacaattttccacaagatcagtgagtgctgtccaatagacatataatacaacccacatacatgactttacattttcttgtagccatagtagaaaaggtcaaaagaagcagatgaaattaatagcctgggcaacaagagcaaaaccccatcttttaaaaaataaaataaaatatggtggtttgctgtccccacctcagaccatttctctggtctttctcattgaccaccactcccaatctttgttctgctgattgattacagcttgtatatatctccatatttctaagcaaaatgtttatcttttttaaatttataaattctttttattatttttcagagacagggtcttaactctgtcgcccaggctggagtacagtggcaccatcgtagctcactgtagcctcgaactcctgggctcaagcagtcttcctgcctccgcctctcaggtagctgagactacgctacaggcacataccaccatgcccagctcaaaatgtttatcttttgatacattattcgagaccattattaaggtggatgatttagttttcttaaacagccatcccctttcttttcctcccctctgcttcaccgcccccattttcccaatgttttaccttttggttaaatcagtactcattgtttacattatttgcctctgcacatagtcacagatagtattgtactgtactgtactgtgtttcttttttaaacattatttctgttgttaataattgactttttaatttttttcctattttgttttttaaagagatggggtcttactatattgcccaggctagagttcagtggctcttcgcgggcatgatcccactgctgatcagtacaggaatttccacctgctccatttccaacctggaccagttcaccccttcttaggcaacctggtggtcccccattcccgggaggtcagcatattgatgccaaacttagtgcggacacccgatcggcataacgcatgcagcccaggactcctgggctcaagcagtcctcccgggctcaagcagtcctcccacctaagcctcccgcgtagctgagactacagacacttgccaccacaccaggttaatttttgtgttttttgtagaggtggggttttgccatgttgtccagactcatctcaaacttctcagctcaagtgagcctcctgcctcagcttcccaagtagctgggattatagacgcatgccaccacaccccatgataattgcctttttttttaatttgcataattttctttgtagcttttgctaatgttcccatatcttcttatagccttacagaatgattttccacaagatcagtgagtgctgtccagtagacatataatacaacccacatacatgattttacctttttttgtagccatagtaaaaaaggtcaaaagaagcagatgaaattaatagtatcttttacttaacccagttcattcaaaatgttatttcaataaatggtcaatatttaaaatacttgagatattttgcttttatttatttcttttgttactaagtcttcaaaatccaatgtgtattttacacttacagaacatctctttttagactggccacatgtagctcagggttactgtattggacagagtggtttcagtttcaagtttttccttggagacatcctacttgaaatttccattctccatgtatctgggtggttggtctatagacttgccactcacagctgtcatcttgagactttctttgcttttcttctctattggatattcagtttcctggatttcaggtcttctcattttcctctagtagttttgttaggtcatggttggtatggcatggttgggatagcgtgttcacacagctatctcgtgagtcatactcctccaatccagcctgctcgcttcccgtgtctgtcatgtagttgtcaccctgctatctctccctccagtttttgcagaaatttcctttgtcttcactcttggtcttcctctcccatcccccatgtatcctatatctttctctttcttggtttatttcatcactcaggtggaaaagatgctccagtggattactgggaaaagggggagcatggatgataaaggtattgagaccttacacgtcagggaatttttttttttttttttttttgagacggagttttgctcttgtccaggttggagtgcagtggcgccaactcggctcactgcaacctccacctcctgggttcaagtgattctcctgcctcagcctcctgagtagctgggattacaggtgcccgccaccacgcccagctaattttttgtatttttaatagagacgaggtttcactgtgttggccaggctggtcttgaactcctacttcaggcaatccacccacctcggaatgtttttattgtcccttctcatttcatgactgctgggctaggtatagaattccagaatcattgttcttagaatctcgaaggcattgcttcattgctggccagctttcagtgttcttgcaaagtctgaagctgtgctaatcacctcatcctttgaaagtgaactgttttttcttcccagaaacttacagaacattctctttgtccgcagaattctgggattgcaattactgtgccttagaatgggtctgtttttatcattatgaagagtactggatgggtcgggaggttttcttgaattacttcttgatgttttctttccttgtatttttttgtttgctaattttctatttttttttcttggtttactttcttgggcagggggatttcttctacttatatttgattcttcagttgagcttgtcatttttgctatcttgtttttaagtttcgagagacatctttgttttatataacattctgttcttaatacatagatgcaagatcttttctttctgagtatattaatatgtatttgaaatctttctattctctgcagtttgtttcccccaagggtttttttttttttctggtttttgttttttgtttttatgttagagactttcctgttatatctggtcatcagtggtacctgcatgtggtggagagtaggggcttattggagtatgagaaccttgagcaggtgtaaggagcctgtcaacactgcgctggcctcagggcctctagggaggctgccagttgtgcattctgaggataccttttggttgtgccttttgtctggtcagattatctagagatgctctgcctcctacctggaggagaagggtctagctgccagcggtgtgagtgtctcttggggaaaaggactcgagttcctggtgtttggcttgtgtatggccgcttaccccatttttggtggagcgctcacatcttccactgtgccaacagtcttgctgcagttcatagaccttctggtttacatttttccagaaagtatgtctttagatttctgcagaagtctgaggagcatggaaggagcttggggaatgagatggcaatccaggtcttcccagatggctctacctttatcccctgcagggaatcccactcctccttcctgactgggagcacagccagagccttgggaggaatctggagtggaaatctcgggcggtctggctttcttactgttcacttgtaattttgctttctcacaactgccaaccactaatcagcctgatttccagcttccagaattctattgctgttgtctgctctcctattcccaccgtaggggatggggctgtctttttttttttttttaattttggtaaaacatacaaaacataaagtgttccattttagccatttttaggtacacagttcagtggcagtaagtacattcacgttgtgtgtatttgtttttttagtaataaacaatataaaattttttaagtaataaaacacaaataaaagattgtttaatgtgattatcgtggaattttaggtgtgatcaggagccatggtgtagtcttctgttgaaacagggtgataggatttgtttaccacctcctaggaaagcagttggatagtttgttggcataaaagtacattttatctatttttaataatcgtagctttatagaaattgcagttggaactcccaggcctggcattcaaggctctctgagatctgggctacccacccatgtcctccagccgtctgtcgcacctcctactgcccactcactgttcctggcatgagatgtgatctccagcccccatgcctttgctgtgcagggtgttccagagtgaattgtccctcctgtctgtctctctgccctcttcctcgtctttccatcttcctgccccacatcactgcctcctacccaaggcctgtgctcattcctcctcggttttcccccatggcctggtacatacctctgaattatcaccttgcatttcccatattgcccggctctctttgatgtctgtttctttgctgggtcttcctcagtgtctgacggtcagttaaatgtctttattcttttttgtaggatatccgacatgaagccagtgacttcccatgtagagtggccaagcttcctaagaacaaaaaccgaaataggtacagagacgtcagtccctgtaagtatccacgtggccggtaccagtcttgctcttcctttgctgcaggcctttttagtcaagactcctttcgcctcagggtttagtataataataaatcaatgtagcagaggtttatgacgcgattgtttcctatagtaaaggcattagagacttatagtaatagctcatttttccaccattatagaagggctcaggtttcagtttctggaaaattcagtgaagttcaaagcacttttcttaagctttgactgtttttgtgatgaatcattttcctaccagctgaagcagagtatagcaggcataataaaaccttttctggatgactcagcagcagcgtcattagggcatgagcactgtgttccgctgtaatgaagccccgcacaggcattcggggtgggcactgtcgtcccctgcgctgaatatgcaaggcagctctgtctggagtccccaccgcctccacccccgccaacctcatcatttttctccctctttcctgctgttagttcttcctaggattgtcagtgtgcctgctggcctgtggcagccctgtccgccttctgagtgattggctgtcagtctgccggtagctgaaaagtaaataacttaacatgttagaatttgcataaagtaaggaaaactggagctgagtacaggacttgaactgcgccatctcctctaggccacagaggcctttttgacccccttccaggtctttagacattgtcaggcagtgaggggtcgtagctgccagtgtctccatggtagcgtgctctgccagggatgcagaagattctccagtcattcctccagtgggcacttcctgcaggtcctgtgcccatggctgggagtggtggctgtcattgttctctgccagaagggttagcagtgcatcctgacctgacttatgtggcgcccagattcctggaaggggtctaaaaatggacctagacttggtgtagaacgtgtgcctcttggcctgccaccatggttccctgcctggttttgtgtgtcagctctgccgcttaagaactgagtggcttcgggcaagttgttctctctcataggagtgtgtgaagatgaagcaacataagctgcttagcccagcgcccagtacctcacgcagacataagtgctcagtaaatgttgtctgtggtggggatggttgtcaccaacatctgaagtgcacttctaggtcatcaggtgacatgattggcgccaacacatggtactcttgatttagcacatctcagctgaggcacctcattgatatttgtttaaaaacaaaaacaaaaaaccttggtgattctgctgtgaagtcctggccagaaacctccagaccgctgatcaacacgcaacagaaccatcaccgttcacctctttgacatggtgccaggataccctggatctctagcttttgctatagttgctctaattagggaataatcttgtctttaatattcctttgctacattttttaacatttcttatctaaatggttttatgaatcagttttacagagaaaaaaaaccagtatttaaaatattcttccaggggctggtccaagtacagtagtgtttacaactatgtgatcacaaccagttacagatttctttgttccttctccatccccactgctttacttgactagccaaaaaaaaaaaaaaaaaaagttattccagggaaacaattctccaactttttcactcccaatctcactcctcttatcttcctcccgtactcctatcctcctcccgtactcctatcctcctcccctactcctatcctccagtagaaacagtcatttgctgtgaaggttatgggggagaatgagtcaaggtagaaggtcacctgctgcccagctcacagtgctgctggtgatgacagcagtccacagttacaggcacttgctgaacgaggggctctgtatacacctcagctcattgactcttcccacaaccctcttgtcacctaccatttagcaaatgaaaaaaccaaggctctgaggtgagttgtttgcccagagtcacccagtgctgtttgaacccactcacataaccaaccaataccattatgtaatttttgaggtcttttatctctgtgatccacttaaaaattatccaagtatctttatttgtactaagcctccataatgagaaacagtgttccagatggtggctagttttcaaagacatctctctttggaattcttctttagaacaaaaagccccagaccacttatccccattcatatcccctttggacctagggagaaggtactatttataggtgatcacctgagtttattgtcccttgtgctgtgccagaaataaaggtccccacctgctcttattagctctactaacaggataaggaaagtggccctcagagagctactgcttttgtgacaaacaaatgatacaagaaaaaaaaagtggctttttaattttagtgacctggggcaggacttccaaatgaaagtttatttctaaaaactaaaaggtaaatttaatatactttcagtgtttgggcttaaattctctttcaagtgtctttgtgatatgctctgaattttaaaaatttagaatcattgaagttcattatacttgaactttaaaaaaaaaaaacaaaaacctcgtataaaggtcaaggtatgacttcatgctgctgtgtacttaggtcatttaatcttcaaaccactggatagaggttaggttgaagttcgatcttaaatcctacctactgtagctcattgtaccagcaacagctgtagggactaggtggaattcatggtgggttttgttcccttttaaagattgaagccaccatattttctgccctctaaaagtttatgtcagccaggcatgggtggctcacacttgtaatcccagcactttggggaggctgaggtgggtggatcacttgaggccaggagttcgagaccagcctggccaacatggtgaaaccccatctctactaaaaatagaaaaattaggtgagcatggtggcctgcgcctgtaatcccagctactcgggaggctgaggcaggagaaacatttgaatccgggagatggaggctgcagtgagctgagaacatgccactgcactccagcctgggtgacagagtgagactcttgactcaaaaaaaaaagttatgcatcagagaacagatcctttgatgccctcctctgccctgaaaggtttttgggggagagtaataagtatcacaacaagatatgacctgagaacagatttcccagataggacatgatccatgttttaatatggcttactgctgttgcttcatagtgtgaagcttcagacacttctgaaaaccctttcagaaaatcccagtcgccccatactgatgactaatctcaactaaaacagggcttcagccagtgtgaatgccactaatgccaccaactcacctttgcttttctgtagggtgtgcacctgtatgtacacattcagcttttccgggattaacctctgagttctggtttgtctttcagttgaccatagtcggattaaactacatcaagaagataatgactatatcaacgctagtttgataaaaatggaagaagcccaaaggagttacattcttacccaggtaagcagattgtctgaattttctatttaatgtcaatttaagagtttgagagtgctgttatccacacctcaaataaaatctgccacatcctttagaaggtcaggatttcagcataccaaaaagcagcaaggaagggggaaaaatcatccttcaaaggttcagtttggttataaggaacgctaatcttttctgggaagcataagatgacattgctggaaatgagagcttatagaaaacaacattaaaatgccagagttgcctgtgtggtctgttggcagagacagcagagccatggctggaggagggtctgtacctgtgttgcttccagaagtatttgtcgtagagcacttgtgatggcaaatctaagaacgttagcagtagaccaggaatctctgtccagagccattcagagtagctcagcatggttctcattctttggccagaagaaaggcatcattggatcatgtgaacaagcatgaaaaatgacttaaaatttctgttggcttttggcatctttatggaaacaaaatcctgaaagtggtttaataattgagcctcttgtaaaacactcagtggcatgtgaccaaaagggtatctgggaaagaggataaaaagagtttctttttaattaatcttctcaagtcttaacttgttacctgtaagttggtctaaaaagactgggtttcttattttgtttttcatcataatttttgtttctcattccatgtcagctttcagtcttatatggctttaggccacagggcgattttgaacatttgtaattttgcttaataattaggaaattaaaattctggggaagacagaatgctctatgaagaaaggctgctttgagcaaggagctaggtcagggcgcgttcaactgaggcctttcttcactgcctttttgtcttgtcccagttcctccccatttatgactaaaatcagcccagatgcttctcgtcatctgggatgcagagcatcagcccagctgtgttcagtcctatggggccattgagtaagttcttggtgcatggatacagggcaggcctttaccaggccctgagcccctggtcctcccagcacctctggggtatttaggggaggctgatgggggagggggttgataaggcgggagatgtctggggatgaggttgaggcaaaagtgacttcttgaggactttgctttttggagaagtcaaatttcctacttcttgatttcagcccttcaactctggtatggagtcaggaagccctttaaatacctgttgtcgggtgtatcatgtcaagtgttgcattagcaaatgaccatgtatccttgtgctactgtcctgcctaccccgcatcctagcgcttccttgggacatgagaagctctgtctggtttgtgaggtggcactggggatgttgagaaactgtttacacagtttccctttgccctggggatttactaaaggagtcgaggcagcctgaccccaaagcatcacccctggacactatgaccgaaacatttccccagtgcccaaaccaagaacacccttcccatttttttttcagtggtgttcattatgtaataatacaagtctctcttctcattttttaaaagtcagaagtacagaagagcagagaataatgtccaaggggccctccttcacctcccccgtgcagtgtcagctaagtgtggtgcgtgtccttgcagatcttaggggattgtgatccttcagaccattctaaactggggtggtgctgggagttagggaaggcatgaagggagtagtggagagctgcagtgactggggtcttcatgccagggtggagaatgcaaggcccaggtggccagccatgtgccacgggatttctggctgccaagagctgtttatctgttcactggggagggaagagttaaatgtggtctgcttttctccgagtcccttcagcacagggagtgctgacttgtcttgttcaggtagtaagttcaagatgagctcaggaaagaaagtgagaggacactgagggctagtggttgagccaagtgtgatgggacttaaagggagaagatttaaagaataaggagcttatgggccggggacggtggcttacgcctgtaatcccagcactttgggaggctgaagcaggtggatcacttgggtcaggagttcgaggccagcctggccaacatggtgaaaccccgtctctactaaaaatacagaaattagctgggtgtggtagtgtgcacctgtaatcccagctacttgggaggctgagacaggagaatcgcttgagcccaggaggcagaggttgcagtgagccaggattgcgcccctgtactccagcctgggtgatggagcgagactctgcctcaaaaaaaattaaaaaaaaataaagaggttaggtgaaaatagatgagaatggaaaccatgagaagaagtgatgctggccaaggacatgacaggttctgatgtggaggtgataggcaatgtctcttccagccactgctaataattgagacaaactcaaggcattcataccctgtgtccagtaaacatctgtgcccattgccaggtgagctggattgaaatgggccagctgctcagcagacaccctcatgccccagtgactctgttccccttgggccacctcattgaccatttatgtttctacatctcctaagtttgttgggccaaggatggaggctgtctgccgtcagggtcctcattgctgatggtaggaatagttgctgatgtttcattggatgttgctgtattctagggactgtgctaagtactttatagaaatgaacatacttcattttcacagttttatgaatagggactattattagtcaagtaagcgatggggaaactggggcagggagcgatgaagtgacttgcgcaaggtcacaagatgatgtgattggaaccaagagaagtgttgtggttggccacgcccccacactgcctctcatctgcaccaaggagttttgtcccatagcccaagggccttggggacgaatctcagtggaggcccttagcgggcctgcctgagccagaaagcagaatcggcatttttctgtccttggttggcccagccctgaactgagatgcggaaatcgcctttcgctgcctggtagaaaatggagctgcagttactgaccaccaggcagagagaggtgggtccctgtcccagcctcagccaccactctgcctaagctgtggggactgagggcgctgtcgttagctgactgcagaaggtgagcacacgctgtagcatgttatgtttcagatgtcacatgttgtgttattgtgtctttgcagggccctttgcctaacacatgcggtcacttttgggagatggtgtgggagcagaaaagcaggggtgtcgtcatgctcaacagagtgatggagaaaggttcggtaagtctcggcttcatttgctgtgtatgtgatcatgcataccactccatatagttaccattttcgtccagatttttaaattatttttcttgcctttgtatttcctttacgtagtatttttatttaaaaaaattaaaacagcagcatataaatgcatgttggttgtcaaccagttaatgaagtgaataaaagggaggaggcggaagaactgcacggacctcttcgcccccgccttctcctgtgtggtgcgtgtggcgctccgcccacctgtgctgcctgtgcggctctcatcacagtgtggagttgtgtgtggagttatggagacctgcttttatcttgaaaagcaagttcttagtgcatcttcatggtgtctgattttttggctggtgagagtgtggctacctctgcggagctgtgggagcggctgactagatgagatttgcctccattcagtacctagactcttgccctgccacacctcttcggagtgagcattgacttcaggatgtgtgtcattctaagttcctgcaacttttcaaacacccctcgggctagcgtgtggctgcacggtgtccatttgtgcaggccaccactcctcttgcatctgggtctagccacctctccttcttgacttaccatagttcattttgtaccatgctttcagaatgagctttctcaaatccaagtctcaccacggttcttcccagctgaaaacccttgtgcggttccctttgcctcacaggataatacatggtgtggcttacggaaccctgcaggtctggccctaggcccctggacacagacctctcaccactcttggaactttagccaggacaaagttttctgtttttagtttcttaccatgttctctgggccgaggagtcccagtgcccacgttcatcccacttgcaggcacccctggacggctgcccccagctccccaactgcctgcattctcccctgccctcctcactctgttggaatagctgagaatagccgatttctgggcagccggcctcctgtgtagactgtcctgtgtagactgtcctgtgtagattgtctgtgtagactgtcctgtgtagattgtctgtgtagactgtcctgtgtagactgtccatgtaaactgtcctgtgtagattgtctgtgtagactgtcctgtgtagactgtcctgtgtagattgtctgtgtagactgtctctgtagaccgtcgtgtatagactgtcctgtgtagactgtctctgtagaccgtcgtgtatagactgtcctgtgtagactgtctctgtagaccgtcctgtgtagattgtctgtgtagaccatcctgtgtagaccatcccatttagaccatctgcctgtgcaggcgcaggccagtgttcagcagggccacaggctcctcggcctccctgccctcgctgctccccaacactgccaaccctgctgcggggtccaggaggagatgggctgaggatcgtggagaccagcaggagcgtgtggcccaggagcagggaactgggtgtccttgggccttgccaggtccaggctcagctaggacacggctctcacagctgtcctggttgcctccggccacagaagaaggtgagggctccagagaggccacctttccaaaaaaagcacagtcatggccctagaatgtaaaaaatccaagtgttaagaaggaacacatcaaaggaaacttcagcagtgaaaacttgaagcattaaccacgaagcctctgcctccaccacacacaaagaaacggctttagttactcgcagaaagtcttcctcttaggacagcgcgtgtttaaaatcataggggtttggtttgttttgttttggggttggggttttttgggggttttttacccttgcctactttttaaaaaatgaaagtgtttatttgcccaacaataacagacagggagcttgcctaagtgttctgttgatgatataatgtatcttgtcttagaaaaaaactttttcagtgaaaggtggtttttaaattttttcttccctccttagtagcttgattagtaaaatgtgaagttacaaatgtgaagcaaacccccacccttcaccactagtcagcaattttgagtaaagaaacaaagcatcaggtgctcacagcacacactgtcttagagggaaggggaagcctggtggcctgtggaagccttcagcatagctccatctgcaggcttctgaccctcagcactactgacacttgggctggatcattgtctgctagggatccgggcagggagtggctgtgctgggcgctgtaggaagtttagcagcatctctggcctctatccaccagatgccagtagcaccccctccccagatgtggcagtcagatgtgtttctgtctagactccagactttgtccaacgtcccctggtaggccaaattgcccccggttgagaaccaccgctctagatggtattgagggttgggaattttaaatcaagacatttattcagaaattaccagatatagtagcatttgcttcttatttatttctttgttgctaagtgtttggcaaaacctctttgctgtgagcacaaggtttgctttagcaattgttgtcacattacagcaaggagtggtgtccagcgctgtagttatgtatttgagcagtgtccagtgctgtagttatgtgttccagcctcaccaggccctgtgcttcattgtctcccactcaagactgaccacaaatggcccacagatccactgtgacaacctttccctttgggttactgtggtggcatcgagaacatggctggttggctttgctgtagtttactgtgataactgtgccagcagtccctgctttcctttgttaagtatcccattccactggaggattacttgggcgtgcagattggcatgaaaagcaatgtatggtttgagattgttaaagtttctttgggatcaacattttcaattctgtatcagcattatccctcccagagggctggctgggagaaatcatgagaagttacagtatcttatttgctcagctaatctaattataaatgatccacacagcttgtggtaaaaccagcttttggggagttttcatttaatgcatacttgtcttctgatttccttccttcaccaaatagtgtaggatgctccctcttatttttggcaaacatgcctgttatcttttgggaccctgggcttcctggaaaccagttatgcagaagatgattgtgtgtgttagactggggtcatccagatggctagagttctcactggttctgtttaaggattgactttagacacctcagtgtaggctgcaccatggcgtaagggttgggattgttgtttagaagggggaagtaagcaaggtgagtttaattggccattgcagaatctcacccgtatctccctcctgaaatcctcactaaagctgccgtttgctttcaggtgctttcatgcacaagacactgcattttgtatcacagggtccatataattcatttttctctcgtacttagttctctgtgttaagaattacttacttagttctctgtgttaataatttttggcgaaaccaaattacccgtcacagggttactgtagatgtctttcataggttttccaaacaccacttgcccacttgtttgggaaggccccaaggactgtttaacatctgccttcatggtggaaacagcaactatgagagatgctagcatgttggcactgccatgttcctctggtaccagcccaagataggactcaatttgaggcctggtgaagtactgtgttctaataaaaatccatctacttttcatggccgtatatatcaatgtaatagggtaactggaaatgtgatcttgtgccttttaaaaattttgtgtgtttaaaacaaaaatttctattggaaatgacagagcatagcttgttgctgtagacacctgagagtccttaaaaataaatattgggttattgacacttagttgcatgacagaattcctcacttgtacagttccaaagtcttagtctttacccagattacagagggttattaagcattaggtttggttttgaaagtgagtgcttgctgtctggaggtgagctttaagactcgtctgccctgcttatgagatgaggaagggtggcctcttcctcctgcatttctgttcttcgcttccttctctgtctgctcactctgtggaatgcccaccccagcacgggtggggtggaacctgtcagatcagtctcttgtttctggggtcttgaggcattataagatctagttgttagaagtgtgggattaattcatcttttcacattcttctaagttcctgcttttagctgccacacccactttggctaagtgggggtcttgccatgtaattagcgcctccatgccaagtggcagaattgcttcaatggtgacagattgtccccattcaagagttcacttttggcaactcatcattgatccaggaaggtgacatggatgaaactggctaagacttcagacaggcttgtgtccagactcttgagaaagctctgttggcttctggtctggcactgtgaagtttgctgtgatgctggcaccacaacctggtgtttcctaatttgtttctcccacattttgctttggttttgtcttttgggcagcttccagctccagtagagcaggaccaataggcatttgtggttctatattcaccctcctcacgtgcttcctggctcctcattgcccccagatgatgccacaggtccctgggcctgctgccagtcgtctgtgatctgggcctctgctggccccttctccagctgctcttttcagcctcttatttgcagtcactgcctaggaaatcctagtcatccttcaaaacctgcctcttgcacagagctttctctgatctctcttttctgtaaccttggctgacctgaaacatttccctcttctgaattcctgctgcatgtccgtagcatttccccctcagccctcccccatagtccaccttgtcactgctgggcacagcagtgtcttctgacagacagctggccctgaagtggttcccttcacccacaccatcctttgccccagaggaggtattgagtgggtcagtgcacgtgaactgccagtgtcatttgccaaagagctgttgacacacgctgacatttcttttgctgaaaatcataagggctttgagcttccctctgtccaggcacatggtcaggctgacccggtagctctgcccctgctgacctgccatttttgtccacaacagttatccatgagcagaaacatttgtgtaactgaggcagaaacttagttcaagtaaaatgtcactaaattcgagtcagtttttgtcttagaccctaaatgaaaccaaattttcataaattttcttgttttaaagaaaaatttaatgagctacatttaaactgagaacatcagatagtgtctgagattatcaaaatagaacatcaaaagtatttttctgaatgaactgaaccaaaccagaatgaaagggcaagccctggggagcctgtctccaagccttctctgaaagggagtctgtatttggtgataactgctcagcctctccaaagggcctcacctgctgtctctcccagttttatttttaattgcctgtgagttttctgtgcagggtaaggcacctacattctatgccagcagcctgatcaggtcctgggtaatgtttgaaatggctacacagaggagtttcaaagccttttgttcaatctggcttcacctcgtagacggtgagaaagcgtcagagccctgcaggatcccgttgccacgtttgaccggggagccgatgggtttggaagtctgagccctgtctgcacaacctgccccggtcagcagcttcgtgcccccacccccatctccccatgaggcaggcatctgtgctgaccatggcttccatgttcagaaacccccaggcctttgagttatcatgaagcttgtgggatgtgctccaagcctcctgccatagaaaaactgccatattgctcacaataattcactattatttgtttccccagttaaaatgcgcacaatactggccacaaaaagaagaaaaagagatgatctttgaagacacaaatttgaaattaacattgatctctgaagatatcaagtcatattatacagtgcgacagctagaattggaaaaccttacagtgagtatagcacacacttcagcacttcaggcggctactggttcacatgcctcttcctttatcccttgggtgatattacctaatgtcagtgttcctggcttttgtataccccgagcaagatgtggtttgggcactgtggtgagcggagcttacttgtgtacctaccaagtgcccagggagggtggaggccacagtgctctctctgacctttaacaacagttaacaccagttcttagggaaaggagagtttcttacccaaaagactggttcctgcttgtgcagctgcagagggactggagcggcagcctgcaagtcccagtgaagcatgctgccttctttgtggtcctcagtcttcgagtctgaagagagggaagaaggggtataggggctcactccagtttcatagctagtgaaagttttctgggccaggtcttgggtttttttgttgtgggaagagtttataacaccagctacttgcttggtaaaagttggtcttggaacatggcaaggcattgtggcaagcagcactgccgctgaacgcgctgctcctggggctttggaataattcccctggatccgtaacttgggggtgttcatgtcattctggggaacagtggagggagtgcgcggcagcacctgggggcaccagtgaagagtggccagccaccaacctctagaacctaactggggtcgaatcctggccccaccttactagctcatcacagtgtctccgtttcctcttctgtcaaactcaggttttgcgagggttctgggaggtcctatacgggaagggttagcagttaccatgggtgtgtagcacgggctttatctgaagggaaggtggagccgtagggagaccatgtggagtggggctccagggctgtgtgggtggggagggatctgcttctgggttaccccatgcctccccttctcaagtactactttttaatcatcatggctcctgccattcatttcatagttgatgtaagccaggtgcggtggctcacgtctttaatcccagcacttggggaggctgaggccaggaggatcactcgaggccaggagttcaagaccagcttgggcaacatagtgagacccccgtctctacaaaaaaacaaaaacagttagtcagacatcgtggtgctcccctatagtccagctactcaggaggctgaggcaggaggattgcttgtgcccgggagttcaaggctgcagtgagctatgcttgcaccactgcactctagcctgggtgacagagcaagaccctgtctcaaaaataaataaataaaaaaaatagtagaagtaagatctagaatgtagcacaggttaccaggacgtaggcaaggggttcgggctgcctggctcttgaggatggtagcagtgcagctgatgtgagtgctttctgccctctggtggtgaccgcgccggagtcaccagccctgccatagccctgatggggcagagggttctgagtacggtggatggaggtgctttctggaagattctcaggagtaacatgggcagtgtgttggaatgtgctagaggatttatgcagtagccttttaaaagaatgctttttagcatttgcaagcctgacattaagagtgacttctgggaaactatttgcttgttgagggaaactgaatttcaacagagcagaagagctgtgcgctttttgcttggcagagtgaatacagccagctcagaggttttgatgttaggatctgtttgctccaacagactttgtttttaaaaggcttttctcagccatagctgtctgttctagcacaaggctggaatgagttccttgtgaaagaggtgagcaggtgtgagggagggtgtcagtgggcggtaacccacaccttcaaggattaaaggaaaacttgcatttggcatgcttgcttcttattcaattttaaaatacattttaacggccgggcacggtggctaacacctgtaatcccagcactttgaggggctgaggtgggtggttcacgaggccaggggttcaagaccagcctggccaagatggtgaaaccccatctctactaaaaatacaaaaaaaaaaaaaattagccgggcgtggtggcgggcacctgtaatcccagctactcgggaggctgaggcagagaattgcttgaacccaggaggcggaggttgcattgagccgagatcatgccactgcattccagcctgggcggcagagcaagactctgtctcaaaataataataataattttttaaaaatacattttaagtccttttcttccccacctgcctccacccaccaaatagaagaggtatttcttcttctttaatgtcattaaggttatatggataccattttctagagaggaaagaatgatggaattgcctagtgtgagtctagcaattatcctaacatacacaaatttctccttgttctgtgccaagatactgtatttaatatttaatgaacattaaatattatttactagtgtatttaatggctgaggcagggttaaatatgtattattttcatcccagcagagttgggggaggtcctagtaactatgccatgagctctgtgagggtgaggtggtgtctttgcccccgcctccctggcacagtgactggcacatgattggcatagtgtggacattcgtcaagtgaaggaaggcatcatgagcagatctctggcctgaatccttctgccatcagctgctcgccaggtggccctggcactgggccacagggaaactctccaggctggtatggttcctgtctgtggctgtcttcccgggcccatgttaggagactttcacttccagagccctttccctctcagggccttgcttaccaagtgactggttcccatttactaggagctcttaggtcattgaagatgttgcgtactccccccagtgagggctgccttttgatcacagccgccagaagcctcaaggaaggagcagagctggaaacagacgccaggccattgcttctgttcctctggggcagacccagccacggaagagacattctgggacaagggctggggtccacctttcaaacgtgtctgcagcaggctctcagcatggactctctgcctccaaacatccacctcctcatcggaaaatggatgggagtgcctgcctggagcagctggtgggagagcgcagcgccagcacgtaggacacactcggttcatgggctgatgccgttcgcattgactgcctcttcagctgggtgttgagccacaccttggagtcaccagtctttggagaccaagtctgctacttttttctctaaagtgacaatcctctgaaacctccagatcatcttgaagcccccgtctgaaagttgcccagagccagtgcctcacctgctgttccttgttcactttttcacgggaggccttgcagggctttatgacaagattttatgggtggctgcccagcatcattgtgactcgtgagacagagagaaaccagttgtaaccatgtagacagtggaagtgatagggagaaaagaggtgaggggactcttcaatccgaagggaaatgaagtctaagcaggcgcaccctgcaggttcagtgtcaagcccagggcctggccccagggtgtggtatttgttgactgggtgtgtggaccctgggagaaagtctgagaatgaatgttcctcttagaggtagagagtggaaggtgactctgtgtgtacttggaattagtgatttctgtacagatgattcttttagaatcatcatgagtatttttctctttcagacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctggtaaggaggccctcgcgggtgccctggggagctcctctacctgctctgctgtgatgttttttcctaagtagaaactgaagcgctcctcttccaaaatacagagactcactgtgttagtctgtttttgcgttactaataaaggcgtacctgagactcggtaatttgtaaagaaaagaggtttaactggctcccggttctgcaggctgtacaagcatggcaccagcatctgctcggctcctggggaggcctcagggagcttccagtcatggtggaaggtgaaggggagcaggagcaagagatgggggaggtcccagactcttaaccagctctcttgtgaatgcattgcctcagggagggcaccaagcctttcatgagggacctgtccccctgacccagacacctcccacccagccccacctccaacactagggatcacatttcagcatgagattgggaggggacagacatctaacggtgttattaacgttgcccttgagaattggacctggctgacttatatctcctctctggctttcagatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggtcagcattgcctttgtttgaatccaggtgtgaccattttaacttttttgtctttgaaggaggctgtcagttgtaaaagttcaaacaccgtctggtgtcaggggaaatagctacccttcatgtttaaaatagctagaaagttgtcaaaatgttcaccatgttgcactttgtgcctttgaagtgctcacatagagagcattgataggaagacgagactttattttcaaaagatttcatcttccaagtacatggctgcagccctgagaggccgagagcccctcgccaagccgtcacctctgctcatgcaaagggatttcctgacaaaccagccgaagtgaacactaataggacttcctcttgctgctctttcaaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaaggtaatatgattgggtcccagcttgttggggtgaggggaaatgactttctgttctagaaacacacgctggtactgaaaccctgtggatgcagcctcctgttggcaagcagcgcttccgcatccttggggaacagggcgcgtggaccacagccactccactcctggctgctggaggtccggtattgggcacagggtggccgcaggacatgagccacttctgtgggcttctagtgccaccttgtggtgcttgttggaatgaggggctcggagccaccgagtagggtttttctgccccccctgacgacagcgccctcccccaggtttccggacagtcctgaaatgtgatgtccaggcttgagtgccctcagtccccacagtggtcctttggggaatgtaaccttttttatgtggtcttgattaaatcccattttacttccttgcaggttaacaaccattattgagtacctattgatatgtgtggtgtactgagttaactagaacatgtcccctggtctgtgttctagaccatcttgctgggaaaaaggcagacccaaagcatattttggtgggggcccatggacagtgatgtgatagaggtgtccgctgaggtggtcagggaaggctgcttgcagtaggtggccgtgcacggaaagtttgcagaatgagcaggtgttagttccagctggagatgactgccggctgtgcccttggtacctgctttctggagggaagttttaagacgtgtgcatacttgacccagcagttgtatacatggagaaatttactttgcagcaactctcaaaacaagcgtgtaaagatgtgtataggtagttgtgtttgttgtggcattgtttgtagtagtgaaaaattagagacaggccaatgatataaccagggacctgatcaattatgttctctcccggtgttgggatattctgtagctcttaaagaatgagatctgggtgtactgatgtggccagacattgcaattgcagtacatgagaaggcaaatcatacagtagtgtgtacaccagtgagtcctccagccagataaatcctcacagtgaccagtcgcccaggcaccttgtgaaccctaccctgggtgtgggtgctatctgaagtacctgggggagggggtgacaagtggacttcaggctgatgtgggccctggcctggccctccctccaagcagagggggctggctcgctggaaggttaacatcatccaactctgtctacacgtggcttgttttttcctagaattcctgccacaatagcagcatccttgccattcattttctccaaagtgagtaacccatctctgccctctgattcctcagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacagggtatgtttccactgacagacgcgctggcgagatgctcgtgtgcagagagcactggccgctagcccgatggtaggattcagttctgtggtgcatctgagccagtctcagaagaaacagatcaaaggtttttaaagtctggaactgtggaagggctaacaagagaattaaggatcgatgcactggggttttaaggagccctctggtcccaagaatataagagtctaatctcagggccttaacctattcaggagtaagtagagaaaatgccaaatacgtctgtttctctctctctttttttttttattcctttgtttttggaaaaaaatagagttacaacacattgttgtttttaacctttataaaaagcagctttttgttatttctggaacaaaaaaaaacaaagtaggcacttatgaaactttctcatacccttaggtgatgtaatcagccatataatttatatttgatttcccagggaaggaatcccaaacttttacgaatgtaaactcccttggagaagagggttaggacgctgttgcgctcaagcccccctcagctgtgtgcacactgagccaggacagggtctttgagctttcccactataagaagaacagcaacaaaaggccgtctagaaaaacagaacctgcctctgcttctgctcagggtgtccccgctgggtttccattgtcctttctccattgctccctcctgtgacagccatcttgctcatgtaccagccctcatcaccccatccccataaatgggtgtcctcgaggcctctgcctgggggtcagaggtcaccacagggtggccattggcatgtcaacccgctgttaattcagagaagtgggctccacctcattgggagaagtgccatttcagcagaaattcacacgttagacgtgtgttgctgttaagtaaggggaagagagaggactagcctcagagctctggccatggaaatgacctcctaagactttttcgtggttttaaatattttacctctttccaggtggcatctgagtacatcagatggttttgcaaaatgcaaacaattttttccttggggatgatttttggggagagggggctactgtaaaaaataaaaccaaaaccccctttgctccctcggaggttgaagttgccggggggtgtggccggggtcatgcatgaggcgacagctctgcaggtgcgggtctgggctcatctgaactgtttggtttcattccagttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacatgaatttggggtgcttcccatttttttctttgcttaatagagctaaaccaggatgagtaactcctgtttctttctatccctgctgatgtgaaacagatgttgtcaatcagctggggttagagttttccacttctaagaattaacctcagcatccctgcattgccagcaccctcaggctggagcgctttccttgactgtgagcttgttgaacaccttaggcctcagcccatttccttcccaaattgacgctttgcctgtgtagggccctcagataacttaacaaacttaccagtgttgtttgaagaacagtgttttgagttgtaatctcaaaaccatatcccttacccaattacctgtaagacacaatggttaccacatctcagtacgtaaagtccacttgatatagaattgacttagaaataagacagattagtatagtttttcatttgtgtacaaaattaaacaatgtaaattccccccaaagtgatttttttgactttttgaagtaattttggacttgcaaaatgttgccaaaatagtacgaagagttccccagtaccctcgaagtttcctcgactgtttcaaagctggctgcaggcccaggctcatgagactgggaagaggacaggctgtggtcatgtggacccacaggggcctggggctgcagaagtcagtgtggcttccaccatttcaggtataaaaaagggcatctaagctttcaagaagagggaggatgctctagggcagcggtccccaaccttttctggcaccaggaaccggttccatggaagacaattttttcacaggcctgggggtggtgagggatggttttgggatagaaacttccacctcagatcatcaggcatcagattctcataaggagcttgcaacctgatctcttgcacacattcagttcacaatagggttcacgctcctaagagaacctgatgctgcagctgatctaacaggagatggagctcaggtggtcatgctcagtcgctcgccactcacctcctgccatgcagtccagttcctaacaggcctcagaccagtaccggtctgtggcctgggggttgaggacccctgctctaggctggtactgctgatgcttaaaaagagagggtttgccagaaatcagatgggacaaaagggcaaaggccgtgccacagagtgcccatataggggagagcacgcctggagccttcgagagcatgcagagaagcctggagactgcatttaccggagctgctgcctgaggccaccctccaagtgtccccacagcgcaccacaagaccacaggagtgacctcctcactggcaggtatttggggaaacaactgctgtctactcttttgggtaaaaagtgaaacaccaatagtttaattgaaatttcagaaaattgaacatatgaacaaggcaaataaatactaagtaagttaaaaacacaaaatatgtccaggaagtatcgatgagaatgttcaagttaaagttctccaatgccattgctacagcaacctcaaaccctaggttctctctgcactattaacacagacatctcaggacatggtttgcttttttttaagacttaaataggaaactaatttttctttctttaaagcaattgcgttcttcagtgaactctttctttaggccagttgatggcttcttagcagtttattgacgagatcctagggtagcttccgaagctgggttgattgattgcatttgggtgcggatggccaaagtgagtggccctactgcctgtgctgctcagggctcctgggctgatgtggtggct

SEQ ID NO: 13 - DNA, 2160 bp, Mus musculus
ggcgccctgctctcccggcggggcggcggagggggcgggctggccggcgcacggtgatgtggcgggactctttgtgcactgcggcaggatacgcgcttgggcgtcgggacgcggctgcgctcagctctctcctctcggaagctgcagccatgatggaagtttgagagttgagccgctgtgaggccaggcccggcgcaggcgagggagatgagagacggcggcggccacggcccagagcccctctcagcgcctgtgagcagccgcgggggcagcgccctcggggagccggccgggcggcggcggcggcagcggcggcgggcctcgcctcctcgtcgtctgttctaaccgggcagcttctgagcagcttcggagagagacggtggaagaagccgtgggctcgagcgggagccggcgcaggctcggcggctgcacctcccgctcctggagcgggggggagaagcggcggcggcggccgcggctccggggagggggtcggagtcgcctgtcaccattgccagggctgggaacgccggagagttgctctctccccttctcctgcctccaacacggcggcggcggcggcggcacgtccagggacccgggccggtgttaagcctcccgtccgccgccgccgcaccccccctggcccgggctccggaggccgccggaggaggcagccgctgcgaggattatccgtcttctccccattccgctgcctcggctgccaggcctctggctgctgaggagaagcaggcccagtctctgcaaccatccagcagccgccgcagcagccattacccggctgcggtccagggccaagcggcagcagagcgaggggcatcagcgaccgccaagtccagagccatttccatcctgcagaagaagcctcgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaatattattgctatgggatttcctgcagaaagacttgaaggtgtatacaggaacaatattgatgatgtagtaaggtttttggattcaaagcataaaaaccattacaagatatacaatctatgtgctgagagacattatgacaccgccaaatttaactgcagagttgcacagtatccttttgaagaccataacccaccacagctagaacttatcaaacccttctgtgaagatcttgaccaatggctaagtgaagatgacaatcatgttgcagcaattcactgtaaagctggaaagggacggactggtgtaatgatttgtgcatatttattgcatcggggcaaatttttaaaggcacaagaggccctagatttttatggggaagtaaggaccagagacaaaaagggagtcacaattcccagtcagaggcgctatgtatattattatagctacctgctaaaaaatcacctggattacagacccgtggcactgctgtttcacaagatgatgtttgaaactattccaatgttcagtggcggaacttgcaatcctcagtttgtggtctgccagctaaaggtgaagatatattcctccaattcaggacccacgcggcgggaggacaagttcatgtactttgagttccctcagccattgcctgtgtgtggtgatatcaaagtagagttcttccacaaacagaacaagatgctcaaaaaggacaaaatgtttcacttttgggtaaatacgttcttcataccaggaccagaggaaacctcagaaaaagtggaaaatggaagtctttgtgatcaggaaatcgatagcatttgcagtatagagcgtgcagataatgacaaggagtatcttgtactcaccctaacaaaaaacgatcttgacaaagcaaacaaagacaaggccaaccgatacttctctccaaattttaaggtgaaactatactttacaaaaacagtagaggagccatcaaatccagaggctagcagttcaacttctgtgactccagatgttagtgacaatgaacctgatcattatagatattctgacaccactgactctgatccagagaatgaaccttttgatgaagatcagcattcacaaattacaaaagtctga

SEQ ID NO: 14 - DNA, 5572 bp, H. sapiens
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcaaaaaaaaaaaaaaaaaaaaaaaaaaa

SEQ ID NO: 15 - DNA, 103886 bp, H. sapiens
cccttgcagggaccgtccctgcatttccctctacactgagcagcgtggtcacctggtccttttcacctgtgcacaggtaacctcagactcgagtcagtgacactgctcaacgcacccatctcagctttcatcatcagtcctccacccccgccccacaacagcctaccctgcctccggctgggtttctgggcagaggccgaggcttagctcgttatcctcgcctcgcgttgctgcaaaagccgcagcaagtgcagctgcaggctggcggctgggaaccggcccgagcaagccccaggcagctacactgggcatgctcagtagagcctgcggcttggggactctgcgctcgcacccagagctaccgctctgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctgtatccatttctgcggctgctcctctttacctttctgtcactctcttagaacgtgggagtagacggatgcgaaaatgtccgtagtttgggtgactataacatttaaccctggtcaggttgctaggtcatatattttgtgtttcctttctgtgtattcaacctagggtgtgtttggctagacggaactcttgcctggttgcaagtgtcaagccaccgattgctttcttaggctatctatatggtctcttcctgagggctattgtccgttaatacagaatacagtacactgttagtggattagcgagctcggtaatccggtctcctaaatgaacaaaaaagtagacgctttttgaggttgagcatatttcgattaaatcttggcttaggccctagatcaagggtttagatcagaataaaatgaaaattagtgttgcacgtacgcatattgcatcagaatcttgcagtgattgttttagtttcctgagttgcattgatagattcttttaaaatatgactgatttgcataactttagaagcagaatcattttcagtatatatggtgcacattgagggcaaaaagtagttttgttaatgtttaaacttaagttacctacaactttgaactgtatgtagaagttttgtagtttgaagtcaatagtgccataatataccttataaggcgttcttactagatctttgttatatttacctttttctctccctatggggtgatgtaggatagtgcttgaaatttgcacttcagtagcatttaatgttcagtgctcttgtcataaacatagaatggatattgagtagtttctgatcccagatggtaatgtgtaggttcaagggtattgtgtgtagcaagtgaagattgcagaaataaaacttcagttcatgcttgaaatttaagtattgttgtgatgccagaattgctgctcaccgtttttaggtttcaggtcctctgacaccttttggtatcgttaattttactgatttgtgtagaatgtcagttgtattttaccagctaatatctagaaatgctggcaagaggggtttactccagctttagattgtaggtatgttagcttttttcatacagtgtattaaatttactgagtcagcttgctgaataagacagaagcccaagaattttaacagtgtgtagctttagttgtctaaaagttaggccttcgggcttcaaaagttagtggtcatcgaaaagcattaatctttgcagtttcaggtacaacacattggttttgattagggatggggatggggccctctttttgcagaatggggaaagtattgacaggaattgagagctattggtaggccagtgtataaggtatgtgaaaacagaattaagttattggtctgaagtgactgaagcatttaggctctatcaaggcctaaaatttggtaatatgagtttggtaatgcgaattgtggcagtggacaatatttagttaaaattatgtaattgcataagtactagcacagtatttttaataaaagttatttcttagcaaatgtcagttgcattttgtctaaaggtagagtgacactacagtgtctatatgtcctgctaaaaattgtggggaatatttttttttaagacagcgtttatatcgggagaggttttattccgttggattatgttagctgcatataaatgtgcacagttaattttgcccaagtttttgttttgaaatgaatgtaaaacttactgaagaagtagcttcccaaaatttagttttctgttaagccaaaaatattattttaaaagagtatttgcaaattttgaagttgacattaattgagaatgttactaaggctaaactggacccgcttgcccagaagataattatggaaaaattcttttgtgacttccaaagcagtctactattagcatgaattactgacagtcatccaaatatataggaacaaaaaattaaatgtttatgtaactttgaaaaaaaagcctttgaagaaaataattgaatgctgtctgggagacagatttctttcagcacttaaagtacataacacactacttttacttttcccacttgattttaaattatcagggttattaagaccttaaaattattttaccaggtttttacatgtgagctgtgacatgactggcattttctttgatttcagcgtatgttggtctctacacatgaaatttgtgtgacttaaaactttctctaaaactgtacttttagttatgatatgcatagaaagcagtatcaaatattgcgtcaaatgactaataacacttaatttctagagttgtggttttattgagccaaaagttgatatgaaaaaaagtcagtaaggaaagtcagtgaagtgcttgcttttttgataattgcactcccaataattttgatattccaacgtacttggtttgcttgttttcacgttaatgttttctgtttattggagtgggaaggcattaaaattgtcattgaagactttgtctttgacatgttgtagtatttatttcagtaactaacctgtgaaaagttaaattcctttatgaaagtagtgattggagtatttttatctgataaagaaagattaataatgaagccatttctccgaggaaaattgaggacaataattcagttttaaaatattatcgcaaaattaaattattctaaaaatttgttagtagggttatatgcttaatattagtctgaaatatagtgctgaatttgagactatagaaaaattaagtgtatttagggtatgtggaaacgttaggcttctgttgtatttttattgtttggtagatttgcctcttttcaaataaatgttcacagggaatacttttaacttgtagagagtacagtgactattgaagttacctaaattacctcaaggtaagtgattactgaaattaatcatgagggttttaaaaagtattctattcacaacatttattttacattgttttgtatctgctaagttatatttcctgaaaaacatgactggaccacctaattgctgtatgataacttacaaacttcatttttcatagtgcttattcaagtgtaaagcacaactgaaaggagtaatgtacagtttatatgaggaaaaaggaattttattgctgccagtgtaaaagtttgcacagcagtatagtcatcaatgcagatttacattgcttataatatactaagtaaatactaaatgattaaagataataaaatatggtgaggtataaccaccttcattttaaacttagttttagaagatagtaaagaaagattcctttattacctttttagaattttatttttaataacatgggaaaggcaactggtgatattttaatttttgtatggaacagtgcatctgctttctcatagccacataaaatacataaacttcttagtgttatgaaatggcttactttttggaagtgaagaagtcttcaattcttattttctaatgttattttgaaatttgcctccatttgctgtttgttcatttggtgatagcgcaacacttaaaaaaatattttaagccgcttctgaagtaatcacttcagtgacttttaatggaggagtatttgttatgggaaattcacttcacaaagttttaacattaattcacttgaagtaaacgtgctatttttaaattttcatctcaatcttttaagtaagacgaaagcttaggaaatcacttttattattgatattgtgtgtgacttcagagtttgtaaagagaattgtagaagtgttgcatgcatatgacaattttctgcttaattgaaatgtgaggcctctgccatactacaaggatttagcttccagaaaatgtaatattaacatagcttaagaaatgtatttttttttttctgtagaaaccgttgggttaaacaaacagttcagaagttttattacatggaacccattagttcttaatcttgttacctttttcttcattttttctgttaaacttgattttcacagtcagcattgaagaattcatcttgtggcctgaattcattaagaaaagatgttaggatttgttctgaagatagtgacttaggaaatttgtgagactggggtcagtcagttctgttttacaattgctttctatttggtagctttgaaattaatttagttgcttatcagagagaataatgttgaggttagactaaccttaaattggtaaggctttgctgagcaaactgataactgtaagtcttttatagggtgcattactgccacatatacgttcttccataggtggttaaaagtatattggtctgtgtttggtgattctctttgtacatattgagtatatgcattcactaatgtaaaataatttgccaagaaaggtgaaattagtatattgtacttgactattcacctttcccttagttttttgaatttttttcattggttgcagaggaagtattagcaatttaattcttttaaaataatttgcactggaataaataagtatcggcaaatataagaagagtaacataatttaagggtgaattaattttatttgggaagttttagttctgtatagttaaggcagattcttcatttgcaacagttgacattgggacatgtgtgaacatcttcaaggtattaggacatcttcaaggcattactttttggcagtgttgagaattttttttttttttttttttttttttgagatggaatctcgctctatcgcccagtctggggtgcagtggcaggatctcggctcactggaacctctgcctcccaggttcaggcgattctcctgcctgaacctcccaagcagctgggattataggtgcatgccaccacgcccagatagtttttgtacttttagtagagatggggttttaccaccttggccaggctggtctcaaactccagacctcaagtgatccgcctgcctcggcctcccaaaatgctgggattacaggcgtgagccactgcgcctggccagtgttgagaatattgagagatggatattgtagctgtacctgccatcaaaagaattttcttgacctccacatagtgtgaaaaagaagactgtttacacattatattttaagtaattatacacataattattatcagtactcaccacttcaaatatgaacagtgaatctaaccagtgtttgatttctctgtgtgtgtatgtgtatacaaagttagcaaaccttttatcttaatatttattaaaaaacgaatttttgtttctttaaagaaaagactaccttagagaatattgttctatagtttttaaatatggtcagatctattttaaattatgttaaaattttgagtattacgtttatctatacttttaagcatatatacattgtttcattttagattttagggaggcagtgtgggctctggagccagactgcttgttttgtaatcctggatcttccatttagtagctggatgactttgagtaggttatttagattttctcaatctattttatctgtaaaatggggatgataatggaacctaccgcatacgtttatcttgaatagtaagtgagataataataagtaatttcatttagcatagtacctgccacattgtaaatacttaaatggtagctactgctctgaaaaactgtaatttcaggttatgtatgtagggaaattatttgtattttcatttatggtgtatgattgtaactgaatttcctcagtttgggccatgttaggattttgtttcaagttataagtgtttttaaaaataagggtattcctttaggaagtctgggtatgacatgtctgtgattttgctggttcatcacaaatgggaaataaatctctgctaactcaaactgttgaccaaagtaaaattaattatgccaatcaaaaactatttgctttaaaatataaaaggcaaaaacttcctattagcataatgaagtagaatttttaaactttgttataatcttaaattttctttagtgttgaagataggtcaacttaactatcatacatttttattcacataaagtaaactctgcctcaaatgtaataaacttaatatgagttatgtaaactttggtcaatagaggtatattttttagcatttccttttgaaaatttcagccttttgagggagtcttgcaactgaatgtcaagttacatttattacaataaaatggacacttaatataatctgtaatgcattaacataatatgggaacttttaaagtattcagtctctgtattattgagtcctatttccacatttggccaggattctcaatatgatttaggcccaagacgtgggaagaaagaagtaaagaactaaaggatttttttcttcatttttttaattgaatatggggaaagatggaataagcttatctgtccagtaaaggccattatgtgtacatagggattattatttttcccccccttgggctgtactgatttcccagatgtaccacagcactcttagtagtgaagcacttgacttctagtgagtggattttttgtgtgtgtgttttatattgcagagtgaatacactctgtctgatactatgtgactttctgattatgtgatttttatgcattttatgtgttttgtaaactagctgtatttttggtccatgtctaggttgtagaattgaattgtgcattttggcatctgagcacagctgagttttctaaatcaatctctctccttgcacctagtttttgctttagatcactacctaagacttactgttgatttaatattagagcacttaagcatagctttgacttttatttcctttgatttttgtagattttcaggctgaagtacaataaggttctctgttctttactagtaattgcaaagattgtattctgtgaattttatttgtttaatacttttgatcttttgaagaggatgtaattatttaaggtattatgaaatgcattgtgatttgaattagatactctttggagatggagttttgctgttgttgcccaggctggagtgcaatggtgtgatctcggctcaccacagcctccgcctcctgggttcaagcaattctcttgccgcagcctcccaagtagctggaattacaggcatgcgccaccacgcccggctaattttatattttttttttcagtagagatggggggtttctccatgttggtcaggctggcctcgaactcttgacctcaggtaatctgcctgtctcagcctgctaaagtgctgagattacaggcatgagccactgcgcccggcctcagatactcttttaattagatgcgtttaaaaatttaacccaccattgctggcatgaatagatgtatttttagagtgattcataaatatcgtatacatgtttaaagttacaaactttttgcttatttcaaaatgcaggattcttttccatttaaaattccctctctttgtgagacttctttttgagtattctggttactctaaactgattggagatgaaattagatagaattgaaaactgtacttttaaaatgaaattttggggatgtcattaagcttgattttttaggttttttttttagtgtgtattataaattattttacactgattgtcagcgataaaatggaatgcctgggattttttaaaatttattttattcatttttataaggtaaaaacagtgttttgctaggcttaatttgaccatgttgtaaaatttattgtataccttgaaagaatcatttatgaaagatactgaattagctaatatatactctgtcttatgtagtttttgattaacaatacactttttaaatcattagctcatttgattttgcaaagaagaacaggtaacctaagaggcagacagaacaggcattacttttatttttctttcttttttattttatttatttatttatttatttattttttgcagcttaggaattgtagctccagtggaatcagtatcttgttaatggctagtgaaagactgagtctgaagaaggatgcaggacttttttggcacttggtgcagtatttttcccattatgttacatgagtggttcttaaacttcagtgtgttagaacaacctgaagggcttattaagctatggattgcttactccaccctcagagtttctgattcagtaggtctggattgggacctgagaatttttatttcttagaagttttcaagtgatgctgatgctggtgctctggggatcacactttgaggaccaccaatgaacattatctcccaccaagcaaacccttaacatgttatactcctttaggttattagaatttatacatgcattatttcatttgacctgtaaactctaagtaactttgcatggaaaatgttatcctgattttatagacgagatagtgagtttagaaaggcagtatggtggaatggagcatagatttggagttggctagacctaaagtccagattaaatctctgctcaaggctgggcgtggtggctcatgcctgtaatcccagtgctttgggaggccagcgttggcagattgcttgagtctggaagttcgagaccagtctgggcaacataggcagaccctgtctctacaaaaaaaaatacaaaaattagtcgggtgttatagtgcgcattggtagtcccagctactgaggaggctgaggtgggatcacctgagactgggactttgaggctgcattgagctgtgattgggacactgtactcctgcctgggtgacagagtgagaccctctctcaaaaataaataaataaatacatccccgctcagccacttatcagttacgtagatacactgcctaaccttagtgaaccctgtttcgacaactccaaaatgggagtaaaaatcctaaacttgtacagtggttttttagttttgttaaaagtacaggtgaggtttttttcagagtattggttgccatctgagagtgatcccctttcacctcctctaggacttttagcattttctggagacattttggtggtcacagctggggtggtagagtgtgctattggctaggggcttgaagccagtgatgctgcttaacatcctatatggcacaagacccctccccatcaacaaagaattatctagcccaaaatgctgtgtaaaatgtctggtatataataagtataatatttgatgaaaatcagtacctttgcccccaggtgtgatatttaagaaggtcaacttactaaatcagtgatggagttagtcctaacatctgggtgttctgactgctgctaggccagtattctttatatgataataagaactttgtccacagaagatatccctaataacaaaaaaggtttatttgaagaggactcatgtgttctttggctgattgtgaaagtgttgctttgaacttctgttagaaaaggttgaagatgttttccgtaagtgtttttaatactgtacgtagtattcagaaggatgtttaattttttttttaattttgctagtagtttttaaagtaatcctttttcctttaattatgtagttgttgaactgttgggagttacttttctcttactattttgttatttaatgtattctttgaccttatgcttttttattctaaagctgcttttattatagtcagatatgatgaagttaaatgtacaatgtaaaattgcaaatttccaacgagctatacaaacttaaatatttctaagtaaagaaaatagggctgactctaaggttctttgatccatgtgttgcattcttttctaggccctaaatttgctatgccagcctgttgaattaaagtgctttatttatctaaattagaaacttgtattaaagtgaagttttagaaaaaaagaaacaaaatcggaatggagttttaggttagcccagagatgggaagatgccaagaaggtagctttagtggattctgaattttttggttttgttttgtttttagggcaggcaaatgtaattacaaaagggttctaggaatagattgctgtgattttttttctgtttgcatgattttacagtttgctttgcctctcacttttgaatgcagaataaaatgtcaaggccttatttttttttaaattcttaagaaatttaagatttgactgttaattccttttgaaatatgggatattttgagataccaattatttaagacaaataggactcattgttacaattcagttgaataaggcttatgatgtttatttcagtatatgaatgaaaactatgtgcttattgtacttaagaaaatttcttttattaaaaacatgactaaagagaattttaaaaatcacccactgtcctacttctctaaaacttaatgttttcatattagcttccagttttgttcatatgcatatactttaaaacctagttcatggtgaacttaagagggtgttctttttaaaaaacaatttccattgcactttgtcgttgccttaattaaatggtgaaatcatcagaaatatttattttcctatacttatacatttattaagcttgtttccatttttttattttgtgattttttaagtggatttaagataacctaaacattagagaggattttcatggttttgattcatgaaatcataatgttatacaaacctaactgaagtgttagagccttgaagatttttcccccgaattacatatagtaactctacttgtatttaatactgaaagcatattttacttatttaagtgagacaaagtaaaatttagctgaatactttagatctatcatttccttttcctgttgtaagaacattacattgtgttgaaattaaagtggatatagaaggtaattagaataaactgccacatcatttttatagtaaagtggtaataacactattgctttctgtttttttaatcagaaggagtatgggcttataatgatgttactgttccctgaagcatattttgaatgatacggtttatatttgcacagttgcccaggtaatcattgtgatattaattgatcaatttgctatttatttgcgttttaaatcagtactagtatttgtgcttaaaaattttgcatatgttttatcagatttaatttttaagtgtcagatactaaaacaaataaccttaactttattaaattataattttttatcatgaggtggtattcatttattcatatagttagaacaaaaaatatttaaaatattgaggtagaaacaaattagtctctttttaattaaaagccagattacttgttagagtaacattttcccaaatgaggtaaaattgttgcgactgttaaacttaaggaaattttgatctaggtgtggtatataccttcttgtggggtgctaatgaaaacagggatggcaaaaatattttgtttgtgagtgtatgcatttatgctttttgacaacctaagaaacactcttacatctgagtatctttcatggactagctgtaggaaatctatataaaatagcttagtatactgaaagtatgacatagttttacatatctagattgtggttgtgattatatataatactataaaatatgctaacgtgctgcttaataatactatttggattttttttaatactgaaaaggtcacacagattgtgattattgtgtagtgtccaagaactaaggcctaccatctgttactcaaatgtatgaaaaagttaagataatttagtgatataagtggttttgacaccactgtttttggaataatctaattatgatttttataaagactaatatcaaattttaaacgtttgcaaaaatgaaacctaatagttatactgttatttatatttttctattacaatacagatactggctgagaactaaagattgtgtaataaacgcctggccttcagtcatttggttttttttttccctcgattgtttggatagttaactggacatcatgttttaacttgagaaattaagttatacaagattttgatattttaaactagttttcctaactggttgagatatataagaatttagtattacaggactcaatcagggaactgatttaataagaatttcttaaaaatttgtttaaatatttttcaagttcttttcttcatcttctacaacttaattcttgtctgtatgcaaatgagcttccccatttaaaattttgctgttgcattttaggccactatagaagttgtttctttaattttcactcacaagaatttggtcttaccaaattgtgtaaatctttaaaattgtgtatttggcttaatattatagaatctgattgatttaatctaccttgtttcatttagtatgttgacattttcttgagaaatttgttatgccaaatgattaacataataatattttaagtttagatatgattttgaatttacattttcaaatgcaactttgtgtctgtggccttttttttttttttttttttacgagaaacatcttgccaattttcagattaatctgtgaggaaagtagattggtttactagactcagtttgtagactttggtgagaactgaattggaggctatgaaaaaaataccttttgggcctttctgaatagacatatatacataaattatatctcttacattaagtgaggcacatatgtaggtgagatttttacctgaatattaaaagtttaaaagtcgttacctattctgtttacttaatagtatttaaagggtgtgagaggtgttatgtgtttctgtcccttgtttttattcctatccctcccatctaactgttggtactcttatcttcccaggtattaaacttgtatgttttaaaagcttatttacttgttgaaatggttaacttaattagttttttctttgaagtttcagcctaaatattttctgtttttttatatgtcctttaaatatgaaaattctacagctaatcataattagtaattgtactttttcccctattacaataactggtttcataataaaatggtatcccttcaataacaagcatttatagtagtttattaaaactaagggtgttatctattcaaaccaagcaatgcagacttactgttgactctgttaatatattttaaaattgcatattactaaaatttaaaatatgattttgactagtattttggtgtatgttattttagatattttgattatgcactacttaagaatgaattgtcaagtatgattataaagttgatataatagttaaccttcagtgggaataggaatcatttaatattgttagatatttgtattattagaacaatctcctatgattcttactaatatagtaatgaatgacagacaatatgttggctttcatatttaaaaattcacatgcatttctagtttatgtttttcttcgactaaaattctgcagcacttaggcaaagctatttttaccagttggaaaaaaagtaagtcatttccaaccaattttcctggcttgtagtatagaataaagagacttgattttattacattaaagccaaatataaaatgatgcaatctagcacacacttgtttggaacttttctcttttaaatattcagattaagaggacgttgaaaggtaaatttttttttttttttgagacggagtctagctctgtcacccaggctggagtgcactggcacgatttcggcttactgcaagctctgcctcccaggttcatgccattctcctgcctcagcctcccgagtagctgggactacaggcgcctaccacggtggcgcccggctaattttttgtatttttagtagagacggggtttcaccgtgttagccaggatggtctcgatctcctgacctcgtgatctgcctgcctcggcctcccaaagtgctgggattacaggtaaattttgattgttattagcaactataaaagttttgcagttggcttattggaaaaagaaaacctccttgccggagacggagacgcatttgtattagaactttgttttctgagtaccttacctatagtaggtttcaaatattggtgaattagttgatggttaggtctgcataattactgcgtatggaaattctggaaccctattttttcaaaatgcagctaatgttgagagaatatgcactaaatattactagatctttgtttttcaagatgctgatatcccttaacatcttctgcactttacctgtttgaatatcttttttgctgtaaaaattagtggccttatgtctttctgcataattatagagtagccaaaacctgttttaggttaatcacctctggcaaaataaatgataaaagcatagcttttgtaagcagaatgatattacagaagttaacttataaatctaagtgtattaaagacacttaggaaatttatgataatgctgggtcagcattacagttttaactttttacagtttttcatatgctttttttgtgattttgctgtagaaaattaacagttggcatttggcttagttcaagtataatgctgttgacaagtatatctgacacgtcattgaactaataatatttttgaaagctgataggtaagttatatctattttgtttcattcgtcattagtgatcggtcttagatgtttttagcgagagcaaaactgtagaggaatgtgtgtctgtgtgtgtatatgtgtgtgtgtgtgtgtgtattttaacagcaggagagttctgaaacaggaaaccagtcttatcatattcatccagagacctaggaagaaggtaattgtttggtatactcgttaaaaccagttggttgggcaacttaaatttttagaggatcacagatgtaggcttgagcagttgtaatagatgatttctttttttttctttcttttttcttttttttttgagatagagtctctctctgtcatccaggctggagtgcggtggcgcgatcttggcttactgcaacctctgcctcccaggttcaggcgtttctcctgtctcagcctcctgagtagctgggattacaggcgcatgctgccatgcccggctaattttttgtattttagtagagacggggtttcaccgtgttccccaggctggtctcgaactcctgagctcaggcaatctacccacctcggcctcccaaagtgctgggattacaggcgtgagccaccgtgtctggcgatagattatttcataattaacacctgctatgaagaaaaattgattaaaatagttgagaagtctagtacactctcagctaatatactaaattatactatggattttagagtattgttaacattatcagtgacttgatatcttcctgaggttctaatttgcttaactttaaataattggggttcagatcaccttgattgttcccttaaagattaaattttgtaaaactgtgtgtaattttcctgtatctggtttggatagctttaaaaatggttcttaagtttaatgagttcaactgggaaaaaagttagttctattttagatgttgtgtcactggaaattatgtttccctgtttgttatatgcacattattacaaagttgtaatcaatgttttcatactgttctctggtctgtttttttcacaaatacactttttatttgtcgccaggtacttatttttaaagctatagaggtaatatttcatcaggtgagggtaactaccatggtttgtttgctatactgtgttagggttattttcgttttttttttcttttataaactatagttgtgaatatgtttatatagtttacttttggtttattagaatatattgctagagtgggattacaggattaaagagtgtacagtattttagttttttttttttttttacaagttgcagatttgttgccaaatgaacgagtttgtagtattgctaacaaggagaagaattactagcaagtcttgatgttacttttgaagagtgtgatgattgcatttaggaagatatctaaacttctgtttcaaagcaaaaagtatgtgcaaatttcttactcatgacaaattcatataatataaaaacatgaaagttgtgaggtcaggttgtttggagaagtagaaaacttcagtagagtttatagataggcagtcttcctttctggtttggcactgacagcagattaactagaaagtgttagaaggaacctaaaatttatactaaagtcaatttaagttaattaatataccagaattccttcttttacaatttatttataaaaacaccatattgagttgccttgtaatgagacatttaaactaaatttaaataacagaattcatgcaccatctaataacaaccccttatttacaattatagagtcctttgcaattttatagatattttcatgtatcccatttggtccttgaaacaattaatgaagaagttacagcaagtggtattatcattattttacagaagaacaaaacaaaaatatatgtggcccagagattgagtgatttacctgaggttataggctttagattgcatagctggaagtagaaccttgttcttctatattaaatgacaatattcattaagtacttagcacaggatttggtacctagtaaatatttaaatgttcctgtgttattcctgactattccttctttattcttaaaacgccattttttgagcactcttaatatttatagttcaaactttgtacctatgtacctttttctctttagaaaataagatttcaggctgcattaatttgatctgtacaggaatgattatatgttttacatattgggacaaattgctctttttttatataccttaagctctagggtacatgtgcacaacatacagatttgttacatatgtatacatgtgccatgttagtgtgctgcacccattaactcatcacttacattaggtatatctcctaatgctatccctcccccctccccataccccatgacaggccctggtgtgtgatgttccccaccctgtgtccaagtgttctcattgttcagttcccacctatgagtgagaacacgcggtgtttggttttctgtccttgcgatagtttgctcagaatgatggtttctagcttcatccatgtccctaccaaggacatgaagctcatccttttttatggctgcatagtattccatggtgtctatgtgtcacattttcttaatccagtctatcattgatggacatttgggttggttccaagtctttgctattgtgaatagtgctgcagtaaacatacatgtgcatgtgtctttatagcagcatgatttatactcctttgggtatatacccagtaatgggattgctgggtcaaatggtatttctagttctagatcactgaggaattgccacactgacttgaactagtttacagtcccaccaacagtgtaaaagtgttcctgtttctccacatcctctccagcacctgttgtttcctgactttttaatgatcactattctaactggtgtgagatggtatctcattgtggttttgatttgcatttctctgatggccagtgatgatgagcattttttcatgtgtctgttcgctgcataaatgtattcttttgagtagtgtctgttcatatccttcgcccactttttgatggggttgtttgattttttcttggaagtttgtttaagttctttgtagattctggatattagccctttgtcagatgggtagattgtaaaagttttctcccattctctaggttgcctgttcactctcatggtagtttcttttgctgtgcagaagctctttaggacaaattgttcttaaataatgaacagttggcactttttcaactggaaaattcaaggaactgctctttctgctttctgctcaatatgaatcttcaatttagaaatgagagtccatcattaacaattcaacatagcttattaataggaaaaaaaaacctagtaacaaatgtaaaatctttgattaaatgagaaagtcatagaagttcatcagatttgtatttaaagcatgatttcattagaaaagttgataataaggatttaactgtgacataattggaaaatacttgtttaaacttaaaattttgaaaagaaatgtaaatgtgatgtaacttatgaatcagtggttgagtttcttttttgctcacaagaaccctaactgtgtgttacttgaaagcactgatggaaatcagggaaaaagctccagaagttcctacgaaataaaattaaatgataaagtcctggtatctgctaacttgccttccattcctgttatcttttcttcttagtctgacttcattaattctttcaccctggctactggtttagctcagtgttttatgagccaggcagcttcagactttgcttttgatgctctttgttcattacctctaaagctgtattatcactttcattttatcattaatgtttcatgtatatgttatagtttcatattgttactgcaacttttacttagctataatttaaaaaatatctgtgatctgtggaaataattattctatggcagaaaagtagttattgcattttactttataagttgtttaaggataagcatacctatatattaagcactacaaagaaacttttacaatggctttatttttagcaaaccatcatagttaaaataagatttagtgtacatgtcaggaacacagtcttatgaaataaggtttagggagctatttttagttactatatcctacttgaaaattgtagttaaatttctagcatataccctattaatttagatgcaagtacagatttgagataaggtagatacattatttggatgtcaactcggaagttgttcaagaaaagatattttgttatttagatgtaacttggaacatatttctagtgtttcaagtcatgattgtatgcctagaacaggcaataaaaatttacttagctggtaaaacagccacattatttcaaatatagtttagttatattatggattaaattgatttttgtggacagactttagaacttaattgctattaattacattttttctttgggacggtatttgttctttggtgagaaaggattcttgtaacacctaaatcaagactgtccaaacatggcatatgcagtttaccagtcaaaacaaactaatcacttaagatctgtgtattttgttttatttgaattatacctcaattaaaacaaatttagcatgtttacacaaaggtggggggaaactgtctaatatatctgagatctgttggagctggggtgaccatccaacttaggcaagatagctagtaccatgtatgcatttcttttacctttcttattgtatatacagtaatcactgatattatgagaaaaagaactttttaataattcaggagatattttatcgctagtatatattgagtgcttattatgtgccttatatactttggactcatttaatcctcaacacaacaaccctatgtagttcatactagaattattcccatttaaagatggggaaagtgatgtttagagaggctaagtgacttgcccatggccaaagtattagaactgggatttgaacacaggtagcctgattcctaaataaatgaccactaacattaaaaagacataaacatagaggtgtttgttgcaatgttagtcataatacctaaaaattgtgaactagttaaatgtccaatagtagtaaaatggttcattaaccatggtacacccatcaatataatgttatattgtcatttaaaattgtattcccaagtttcgtatcaggaaaatataataaatttttgaaaaatgtaatgggatatattgtatttataatacagtaatcactatgtaaccaacatttttatttccatcaaaaattagttataaagaaatagaaatctaagaagtttaatagatattaccattgaacactagatttgtattagtatcttttatatttatctctctcatttcctatattggccatgtttacttttaaaatagtaaaagtcataagctctattttaaaaataaatgttagtttattaacccaagaataatagctaactataaattcatatttgataaaataaaaagatgacattcatcataagggatacatacctgtgctagcatatggcatttttaaaatcacatgagtaatttgtaatcatcatagaaatattagaaaatacaaataagcaaacacatactgaaaatttagtgttcccaaatctaaaacagagacactgtttttttcttttgggattgtattttagatatgttcttaagttataataaagtaaatacttaaaaggcaaattgatacattaaggatttcaaagagtaaaactttttgttaagctttgatgttctttagaaagtttagattattccacaagtcactgtcgttgaaagaaaagtagttacagtggggtcttatgggataaggcattaccatttgttcagttgagagacagctatcactatgttttaagcattgttcatatattagctcatttaatcctcatagcaaccttatatgataggtacctttattagccccattctgcttaggaagcaacagaaagagtatgtattttgcctaaggttgcacaataagttaagctggggttccaattctagcaagttggttctagagtgtatgttattaaccattatgccgtagtgcctgcaagtagatctctagatgtcagaaatactcatcttcctctggttacctggttgttataaatctttatgcttaatacttatgtcattatatgtaaatttcgtattaaacactcaacttattcagaagaatatcaggtaagtgtaggttaaggctgttttctatcagaaatcattatatgtatatatattcctcagttcttatgttgtttagtttttctaaaatgtcaaattttataatatatggagaagtataaatgtatattagaaagattttgtttatttgtgtaatttgtggcataagaaatatttgcctcaagatttggtgcttgtttaggtagttgctggcattacttttggaaatgtcagtaaattttcatactgtcttggaattttttcaatttttacattttattagtaaatgtaattacaggttagtaaatcacttatttgaacctgtttcctttgaaagttttatatttttatttggaaatagaaaaaccttaatttcctctcgttgggcagtatggtgtcaaaagcttgggctttggagcttcgtatataatctgggttcaaattataacttactagttactaacttgggcaaattacccagtctttttgactctcaatttctttgtctatgaaatgtaatactatttaggattgttaggattaaatgagaatatatttggcatactgtctggtacatgatacttaacaggtactagttgtctacatctttctaacttaggatggatgccgatgtcttgggtaacatctcaaactttatcagtaaggaaggtgagaatctgaagaaaatgaaaccttaaaaagattgaattcctggactccatttaaaggagtaaatagctcacgaacaagacttgctgctctgcaaagtcttccatgttgatcctggtctttgactccttatctgtctgattaaattgaattcgctgccgtggcatccttaaagctggaccttactttgtcagtcctgccttctccatgttgctttgtgtgtaagcttcactggactgtttgctttttgctgattattttatgtatttccatatgtctactttagcctttgcttggaatgttctaactgctcttgtttcttcctctgtttactggtttctgacttaactcttaaggattatctaatatattacctacttggtgaaggtttatctgtgtccccacagaattaatccttccctctttaactcttaagctatcttattttttatctaatcgggtctttggcacaattataggtctgtgtgtctgtcttccctaatagaataggaaagccttgaggacagtagtctttgcttacttagccttatattctcagtgccccttgtgcaaaacgttcaatatatgtttgaatgattatgtgaatgaaggagggggccagctgaatttactttaatgattatgtaacacccatttatgtatagttatagacttgtctgaaatgagttaaatcctttgcaacgtttgctgctatgctttgaatgtctcttacaaaactcatgttgaaatttaattgccattgtaatggtattaagagatggaacctttaagaggtgattagataatggtatctctatccttatgaatggattaatgctgtttgaatggtagtggatgagttatcttgggagtttggcctcctccgtctcacatgcttccttaccttctgccatgtggtaactcaacacaaagatccttgccagatgctgatgccatgctcttggacttcccagtctccagaaccgtgagccaaatacatttctgttcattctaaactacctgttttgtggtattctagtaaagcaacataaaatttactaagaaaactggtaccaagagtgtgattgttgccataacaaatacctgaaaatgttcaaatggcttgggttctggctagagaaggatggaagagtttggatgaacaggctagaaaaagcctgtattgctgagaatagagcattaaggacaattctgatgaggattcagaagaagagagctgtagggaaaatctggaacttcttagagagttgtcatcagttggtagaactataagtggtaaaggtctttctgatgatatctcagaaatgaagaacaagatactggacactggagtaaaggccatccttgttaaatagttgcaaagaacttggcgaaattatgttcatatcctaagactttatggaatgcagaatttaagagtgatgaactaggatatgctgcagaagaaataactcagcagcagagcatttaggttactggatggctacttttaaccacttaaactaagctgggggaagggaatgacttgaagacagaatttataattaaaagagaggcagaatggaaatacttggaaaatttgcagcctggccatagtaaagaatgcaaaaggtatgtttaggagagcaaaccaagggtgtggtccaggaaccatttgctgaagagattaatattcctagaggagacccaagggctatttatcaagacagtggaaaaagaccccagaggcattttggagatctttgaggctgcctgccccatcacaggcccagagctctaggagggcagaatggtttgtggctcaggtggtccttcacaagcttgctgcccagggctacctcagctccccatatttcaacccagtgggccttggctgtcctaggtctggttcagaggggcccaggtgtggcttaggctactgctgagtactcaaatggtaaaccttggcagcgtctatatggtgctaattctgcaggctcacaggatgaaagagctgtgggagacatggctaccaccaccaggatttcaaaggatgatggggatagtctgggagagacttgccacaggcttggagcctctgaagggtggaaatgtgggttggagtcactacagagagtccctactagggcattgcataatggagccatggcagcaggcccaccaccaaagcttcagaactgtagagctacaagtatacagtgccagcctgggagaacttcaggcttgagaccctaacctgtgaaagctgcatgggctaagtacagcaaagccatggaggtggggcttcccagggtctattgggatgaaacgaatgtattttgtaggtgagaaggacatgagttttgaggcccaggggcagaatgctatggtttggttgtttccttcaaaactcatgttgaaacttcattgccatgtggcattattatgaggtggaacctttcagaagtggttacattataagggctttgccttcattaatggattaatgccattattgcaggtgtgggttagttatctctggagtttggccccctttttctctatcatgtgctcatgccctcttttgccatgtgatgccttctaccatgttatgatgcatccagaagactctcaccacatgcagccccttgatcttagacttctcagcttctagaactgtgagtgaaataaacttcttttctttataaattaccccgtctgtggtattgtatagcagcagaaaatagacatcagcctgaagttcccccaggctggcattaaatactaattattaattagtatttatagtgcaaggataaattcaagtttagccctggttagaatgaccacatttcaagggaggggctttgtacttctgtgcatatctgtaaggataaaaatcttaatactattctcactgaaattaatggtttaggttaggtaaggttgttagtgctaataattatttcttttaataaaatattcttagttgcgttgttcaaaaaacatagatgatttgaatttatattttttggccaaaatatatttataattttgagtaggaattccagagtattggtagctataaccactttgggttccctgccattgcttctggtgcctcattttttctgacgtcttccattttcttacatttgtcttctaaggtggagttaagattactcagttaagattatttcactttaggcctctgctgtcttctgcttttttttttaaaatgaatggatataatatcccaatacattttgataattgaacaacagctacatttttaagtgaggctactttcttctaattttttaaatttatttttctcagtttttaaaaaaaatgtcagattggctaagagttggggcagctttcttatgtgagagtagtagatgacagcaaatatttgtgatgttaaaatgataatcctaatagttttcttttagaatctttataataaaaaccctttgaggctgagggtgaatttgtatgttcctaaagtgacaaaaaatgttcttggggcatagtaatttaaatcttagatgcttttattagtataattttttggtagaaatttggcattaaaaaatgcatacagagctttttctacatacagggcaagacagcattttgtcatggcaattagtaaatagataattataaaacatctaattttaagcaatttgttacagaaacgatacaggtacattgtggcaaaaatagaagatacaaaacaagcaaatatgagaaaaaatatacatgccaccacctatatatgacttttagtactttataatcttttgtctatatatgtctatatggatatatacgtattctttttatccaaatggtattacattgtacattctgttttgaaacctgccttttttagtcatttacatctacttttccatctcagtaacttttcatcttgtgtaatgcccggatcacattaaaatgtttccaattagctcaaaaatgtcctttatggctggtttggctaaaacagtatccaggccagcattgcacctatgaaattggctgttaggaatcttgtatctttaaaaatcaagggcagcaacccatcctcccgcttcccccacctcccaccacccccccaccttttttttttcttaaagatactggcttgttgaagagagaatgggtcatgtcctacaaactgtctgaatttgtccagtttgctgtctcatagtgtcatttagcttgttttatcctatgtatttcctgcaaattaaaatttgtatctgaatccttggtggatttgagttgaagatccttaaccatcatagatgatgctgtgtcctttatattgcatgtcagaagttacatgatctttacttgattcatgatgaggagatggccactgaaattggacagtgacagtcttttctgcccattgttcaattatattcgtctctttacattagaaagtattttgggtagtagtattttggtgctgtaagaaagttcattttctcatcaaccactcacctattggtttaacaccatttgttgatctttgagtatatcagtaatttcatcagggtttgcaaaataagactttaaattctattgttttacattattaattgatgttttttgataaggtagaacttgtgaaatgggactatttgtttgtctttaaatacagtctctataggaaagacaaaataaatacttaaatctcactctttaccatttttcaaagtgaagaactattccgttaaccacctcaaaagatgataaataaaaagggtatttttagttgtttcaactttttttttttttttgagatggggtcttactctgttgcccaggctggtgtgctgtggtgcaatcatggtacaccgaagcctcagtctccctgggctcagatgattctcccacctcagcctgggactaaaggtgtacaccaccatggccagccaatttttttgtattttttgtagagatggggttttgccatattgcccagcctagcctcaaactcctgggctgaaggaatccacccatctcagcctcccaaagtgctaggattacagacgtgaccaacaatatccggccttaacttttttcttttgagtgtctttatagactcaaggacttttatttaattcagggtgttagtaccatttaaatgttttctttgatgctcagattatcacagctagtcatttggacctttataccacctcctatgtccatttgatataggccattaatctctataagccttcctccttctcttggaatgaaaaggtatcctaggctcacctgtaccttccctactccagacctggcattaagtctttttccaaggagtttggtaccttttagtttattatgatattagagatgaaaatctgtgttctaggaatgtttattactgctagagtgatgttgcttttaggccatttcagagaaaagacctagaaaacagatttttacaaacatgaattcatactgatatttttagttttttacatgatttcttgattttacaatattatctgctttcttaacttaaaattatgaaccttaaagtcattagcataacttctttgcttatttctacaacataaagaaaatagtcctggtgcggtggctcacactgtaatcccagcactttgggagattgaggcaggtggattgcttgagctcaggagttcaagaccaacctgggcaacatgatgaaaccttgtctttacaaaaaattagctgggcatggtggcatgtgcttgtattcccagctactcaggaggctgaggtgggaggatcacctgagcccaggaggtcaaggctctagtgagccatgatcatgccaccacactccagcctgggtgacaaagtgagaccctgtttcagggggaaaaaaaagataaaatagtttgaggaggctggatgtagtggctcatgcatgtcatcctggcactttgggaggtcaaggtgggaggatggcttgagcccaggagtttgagaccagcctgtgccacatcatgagacctggtctctatttaaaaaaaaaaaaaaaagaaaatagtttgaggatatcaataatgatattactagaatcagtaaaactaccaaaagaagtttaaagtttcttcctagtgtttttttgttcttagaatacttcctaccaagaagtgcagtaaaagtgcagtgtccaaatagcccttgtaacaaaacctttctctttctcctgggtgccaatttgacatttaatcagttttgtttctagcagtgttcaatttattagattataagtcttttttttctttatattattctaagatcaaaaatatataaagatatacacaggagtcctgctgctacctgttcttgctatgcttttccccttttcttccctttctctgtgaagcagccatttttattagtttcttgtttatcactcatgcatgcatatgtttattgaggatgttgacattcaagcaaatatatgggttaacattctttttgtcatccctatacgaaagatatacccagtatactctattgggtgggtttttttccttaaaatattcagtagatctctccagttagcacatagttatcttatagatagaacatatacatataaccttttcttaaactatgctattaaaataatagctttcagtaacttgataattatttttggattgaaaatactactgaaatcaactcaatcatgtgaaagctgcagaaagaaaaagacctagaaaaagggcattggattaggtcaactttgaattttatttggaagataaatgagtccagaagtgagtgggcagagattattggagttggtcttgaaatgaggcgttaggcagattgactgggctggtgtgaaaggtctgtcagaaaatcatgagattagattgaggtacctcaaaaaatgagagctggtatgatgagtgggtaagaatcataaaagcgtagagtgttgatgatttttatagtttataaatggttcttgtgtgtagagttttgtttttatgctagctatagtctgtaacataattcactataatgggcatgctaaatatccatgacagttgacccttgaacaacacagagggtaggggcgcctacccctgtgcagttgaaaattcacatgtaacttttgactccccaaaacttaatatttagcctatacttgactagaagtcttactgatgacataatgttcgttaatacatattttatatatgtgtcagatagcatatttgtataataaagtaagctgcaggaaaaatattaaaatcataaagaagagaaaatatacttactattcattaagtggaagtggatcctcataaaggtcttcatcctcactgccttcactttgagtaggccgaggagtaggagagagaggaaaggtcagacttgctgtctcatgggtggcagaggtagaagaaggtccacatacaagtggtccgacacagctcaaaccggttttgttcattggccaactgtagtttgattgaaagtaataataaatgaagtttctgcctcagttcagtattatcaagtcatagatagcaagggctggaagaaaccttagtagtaatctctttgagtctaattatcatgtagaataggaaattgcggtctagaaaggttaagtgacttgtccaaattacacaactagttagagacatagccagctcttaaatctgacttccagattttcactgtgtcttcttttttctgtaacgtgttgccttttttagccatgaaaaattagaagttgaactcttgtcttttcaggcaggtgtcaattttggggttttgttttgatttttggtttttgacataaagtactttagttctgtgatgtataaaccgtgagtttctgtttttctcatatacctgaatactgtccatgtggaagttaccttttatctttaccagtattaacacataaatggttatacataaatacattgaccaccttttattactccagctatagtggggaaaactttcttttcataactagctaatgttttaaaaagtattcttttagtttgattgctgcatatttcagatatttctttccttaactaaagtactcagatatttatccaaacattattgctatgggatttcctgcagaaagacttgaaggcgtatacaggaacaatattgatgatgtagtaaggtaagaatgctttgattttctatttcaaatattgatgtttatattcatgttgtgttttcatttagaaaagatttctaagccacagaaaaagatactttgtgatgtaaactattattgtagtgctctataatcattttttggcttaccgtacctaatggacttcagggggatacagttcatttgataagaactgaccttatacattacataatcaggtacttatgtgatatcatttcctggactccataaaatgctggtcaccaggtttaatacctggattccattacagtgtgatttttgtcttatttcatagttggggattaggcttaaaatcctagagtggatttattcagttaaatttattcacactaagatgtagatgactaatactgtatatttttatgtagaccaaattttaaggtaccactgtgcatatgtataccaactacctgaagaagtatttggttggtacaagagatatagaaaggaatcgctgggtgtaccaaggctaatcagttttataattttgcataattttctaactgcgattatcatttagtttagaacaatttatttctcaaggcccatgtaaatattatttttaaaatatacagtcttaagaattcatggcatattttatgaaaggaggaattcatgtctgatgtgcaaatagtcttaagatattttctaatttcagagcaaaaatatatatgtatgaataaattaactgtaaattgtcagtaggaaccttaagaattcgtggcgtattttatgaaaggaattcatgtctgatgtgcaaatagtcttaacatatttgctaatttcagagcaaaaatatatgtgtattaataaatcaactgtaaattgtcagtaagaaccttaatggctttaaaagttaaaatttcaggtcaagcattgtggtgtgctcctgtagtcccagctacttgggaggctgaggtgggaggatcacttggcttgaacccccaggtagagggtagaggccagtctgggtaacacagcgagaacccatctcttaaaaaaaaagtttaagttgtggattatttcctttacactctttcattagtatctttcctggagactttcaatttaaatacttggtgcttatgacaattagatgttaaaatggatgggaaagtactttgtaacttataaagcattatgcagatgtagactccttttataatagttgtgtaagtatataagacaacctacattcttcatgagctagccataagttttagcaacttgctttgaaccacggtagatttacaattttctgtagtattgagttgtgttcatttagaattttgtaatatttatattgaaaatcaaatttttgtacctacaaaaactacaaaaaaatccccctagtttttatagtttctattaaaattatagctggtacatagggatgccagaaggactgtttaagaagctgaaaatagagaaatgaatttatcttctcatagttaggcagggcacagtagaaggatgcttaacattgcaagctgatgggaacagcaggttgatatagcttgtgataacacttctaaagaaaaagcaatgagccatagaaaaaagaaaaagatacattttgaattaaggaagatggtgaatctgggaagtgagcagtacagtcaccagacgtgtatcctctcctatggtacagaagtgtttattgggtctctttatggcctgcatgatatatcccacaagatgacctacttcacattattttaattctgtattcaactaagcactaattcaacccagccagattagtactcataccaaaaaagagtgaatactctgaatagagggcaggttttctgattatggtgagaatatctttgtggtaaattaatctggtgtgctagtttttacgttggtctcttctcagtgtcgttagtcactgaggctgattgatcatcttttaggttactgataaagttcctgtacagctgattttcagaccttagattgcaataacttcaccaagaaaatacttcattgggaagcattttggtccttccatttgattcataactcttacctttatgcctctgaaggaaaagatttatacattcagcttgtaattagtaatcaagactgaggtttagtctatctagcttcacaatctatctagtttgttttgtctagccatatgatttcttcaaatatgccatttcttaaaaaaaaatgttttatgtatcccgattaatatttagccagtggttcttttagccgatggatcttgtcacctcttatgatactattaatagcatgtcaacatgaagaattatctgctgaatataatagctatgctgtccttgtttccttttgtctcattcttttttgattgggggataattggccaataaagctttgatagcctctattgcccaggcccctcctcttcttttatgagagaaaggatgaacagtgaccagaaataaaggtattgtttttttctatcaactaaaatggaaataaataattcctaagtaatttgcctgttaggattaaagtctccaagagaatggctgtgcctagtacctaagtgattaatttccttgattggttcacattatattgaggatattagtaatcagtagtgattccttttttggttcaaagatgatagtgtcacagtgaaaaatgtttttaaaatttttgtatacttaatttttctgttaacgaaagtattttcagttggatttttgtttgccctctctattagaatgcccaaagaatatttaaaattttccttttctcttatactgcatatttttcctgtgatttttccccaaacggaaaatactctgcagagattagactttgttattgttgtactacatcattgctttgactaaaataaactcagattgcaaataccttcaagcttacattgctcagtatttttttttttttttttttttgagacggagtctcactcttgtcgcccaggctggagtgcagtggtgccatctcagctcactgcaacctctgcctcctgggttcaagcgattctcctgcctcagcctgcggagcagctgggattatagatgcccgcccccacgcccagctgatttttgtatttgtagtagagatggggttttaccttgttggccagtctggtctcaaactcctgacctcgggtgatccatctgtctcggcctctggaattacaggtgtgagccgccacgcctggctaaattgatcagtattatttaactttgagggatatgatttgttatggaatgcgaagttttatacttgaggtactcagagtccttttgagacaaatatttaacttctccttttgaggttaccgcctacgattgggaattaatgtaaaaaataagccaaaagaaagtgagggaaaagtgaaccaagctgtaatttttttactcttttttattgttgttgttattgttgctgttttttactatcttgattgcaacagtttggcttatatatatagcatttggaattgacagtaagaaagccacatctcatagaagctaactattcccaaattgtttttttcttcttttcctcttactactgctgttttcctcctttcttgctgctaagctcttgtcctgacatgctggtaatatgaaacagtgttttattcagataattgattattctgtaatatgtatgttaatcttttttattacactttaagtaatagggtacatatgcacaacttacagattcgttacatatgtatacatgtgccgtgttggtttgctgcacccattaactcgtcatttacattaggtatttctcctaatgttatccctctcccaaccccccaccccaggacaggccccggtgtgtgatgttccccgccctgtgtccaagtgttctcgttgttcagttgccacctgtgagtgagaacatgcggtgtttggttttctgtccttgcgatagtttgctcagaatgatggtttccagcttcatctatgtccctacaaaggacgtgaagctcatccttttttatggctgcatactactccgtggtgtatatgtgccacattttcttaatccagtcagtcattgatggacatttgggttggttctaattctttgctattgtgaatagtgctgcagtaaacatacgtatgcatgtgtctttatagtagcatgatttataatcctttggatatatacccagtaatggaattgctgggtcaaatggtatttctagttctagatccctgaggaattgccacactgtcttccacaatggttgaactagtttacagtcccaccaacagtgtaaaaatgttcctgttcctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtctataaatgtcttcttttggaaagtgtctgttcatatcctttgcccactttttgatggggttgtttgatttttttcctgtaaatttgtttaagttctttgtagattctggatattagccatttgtcagatgggtagattgcagaaattttcttccattctataggttgcctgtccactctgatggtagtttcttttgctgtgcagaagctctttagtttaattagatcccatttgactattttggcttttgttgccattgcttttggtgttttagtcatgaagtccttgcccatgcctatgtcctgaatggtattgcctaggtttgcttctagggtttttatggttttaggtctacatttaagtctttaacatttaagtctttaatccatcttgaattaatttttgtataaggtgtaaggaaatgatccaatttcagctttctacatatgactagccagttttcccagcaccatttattaactagggaaccctttccccatttcctgtttttgtcaggtttgtcaaagatcagatggttgtagatgtgtcatgttatttctgagggctctgttctgttccattggtctatatctctgttttggtaccagtaccatgctgttttggttactgtagccttgtagtatagtttgaagtcaggtagtgtgatgcctccagcttttttctttctgcttaggattgtcttggcagtgcgggctcttttttggctccatatgaactttaaagtagttttttccaattctgtgaagaaatttattggtagcttgatggggatggcattgtttctataaattaccttgggcagtgtggccattttcacgatattgattcttcctacccatgagcatggaatgttcttccatttgtttgtgtcatcttttatttcgttgagcagtggtttgtagttcttgaacaggtccttcacatcccttgtaagttggattcctaggtattttattctctttgtagcagttgtgagtgggagttcactcatgatttggctctctgtctgtctgttattggtgtataagaatgcttgtgatttttgcacattgattttgtatcctgagactttgctgaagttgcttatcagctgaaggagattttgggctgagacagtggggctttctaaatatacaatcatgtcatctgcaaacagggacaatttgacttcctcttttcctaattgaataccctttatttctttctcttgcctgattgccctggccagaacttccaacactgtgttgaataggagtggtgagagagggcgtccctgtcttgtgccagttttcaaagggaatgcttccagtttttgcccattcagtatgatactggctgtgggtttgtcataaatagctcttattattttgagatacgttccatcaatacctaatttattgagagtttttagcatgaagggctgttgaattttgtcaaaggccttttctgcatctattgagataatcatgtggttttttgtctttggttctctttatgtgatggattatgtttattgatttgcgtatgttgaaccagccttgcatcacagggatgaagccaacttgatcttggtggataagctttttgatgtgctgctggattcggtttgccaatattttattgaggatttttgcattgatgttcatcaggggtgttggtctaaaattctctttttttgttgtgtctctgccaggctttggtatcgggatggtgctggcctcctaaaatgagttagggaggattccctctttttctatgaattggaatagtttcagaaggaatggtaccagctcgtctttttacctctggtagaattcggctgtgaatctgtctggtcctggacttttttcggttggtaggctattaattattgcctcaatttcagagcctgttactggtctattcagggattcaacttcttcctggtttagtcttgggagggtgtatatgtccaggaatttatccatttcttctagattttctagtttatttgcatagaggtgtttatagtattctctgatggtagtttgtatttctgtgggatcagtggtgatatcccctttatcattttttattgcatctatttgattcttctctcttttcttccttattagtcttgctagcagtctatcaattttgttttttaaaaaaaccagctcctggattcattgattttttttttgaagggttttttgtgtcctatctccttcaattctgctctgatcttagttatttcttgccttctgctagcttttgaatttgtttgctcttgcatctctagttgttttaattgtgatattagggtgttgattttagatctttcctgctttctcttgtgggcatttagtgctataaatttccctgtatacactgctttaaatgtgtcccagagattctggtacgttgtgtctttgttctcattggtttcaaagaacatctttatttctgccttcattttgttatttacccagtagtcattcaggagcaggttgatcagtttccatgtagttgtgcagttttgagtgagtttcttaatcctgagttctaatttgattttactgtggtctgagagacagtttgttgtgatttttattcttttacatttgctgaggagtgagtgctttacttccaactatgtggtcaattttggaataagtgtgatgtggtgctgataagaatgtatattctgttgatttgggatggagagttctgtagatgtctattaggtctgcttggtgcagagctgagttcaaatcctggatatccttgttaaccttctgtctcgttgatctgtctcatattgacagtggggtgttaaaatctcccgatattaactgtgtgggagtctaagtctctttgtaggtcactcaggacttgctttatgaatctaggtgctcctgtattgggtgtatatatatttaggatagttagctcttcttgttgaattgatccctttaccattatgtaatgcccttctttgtctcttttgatctttgttggtttacagtttgttttattagagactaggattgcaacccctgctttttcttgctttccatttgcttggtagatcttcctccatccctttattttgagcctgtgtgtgtgtctgcatgtgagatacatctcctgaatacagcacactgatgggtcttgactctttatccaatttgccagtctttgtcttttaattggggcatttaccccatttacatttaaggttaatattgttatgtgtgaatttgatcctgtcattgtgatgttagctggttattttgcccattagttgatgtagtttcttcctagcatcaatggtctttacaatttggcatgtttttgcagtggctgataccagttgttcctttccatgtttagtgcttccttcaggagctcttgtaaggcaggcctggtagtgacaaaatctctcagcatttgcttgtctgtaaaggtttttatttctccttcccttatgaagcttagtttggctggatatgaaattctgggttgaaaattcttttctttaagaatgtagactattggcccccactctcttctggcttgtagagtttcagcggagagatctgctgttagtctgatgggcttccctttgtgggtaacccgacctttctctctggctgccctttacattttttcctgcatttccaccttggtgaatctaacaattatgtgtcttggggttgctcttctctaggagtatctttgtggtggtctctgtattccctgaatttgaatgttggcgtgccttgctatgttggggaagttctcctggataatatcctgaagagtgttttccagcttggttccattctccccgtcactgtcaagtacaccaatcaaacgtagatttggtcttttcacatagtcccatatttcttggaggctttgttcatttctttttactgttttttctctaaacttctcttcttgcttcatttcattcatttgatctgcaattactgataccctttcttccacttgatcgaatcggctgctgaagcttgtgcatgcgtcatgtagttctcgagccatgattttcagctccatcaggtcatttatggtcttctgtacactgtttattctagttagccatttgtctaatcttttttcaaggtttttagcttccttgcgatgggtttgaacatcctcctttagctcggagaagtttgttactactgaccttctgaagcctacttctgtcaactcgtcaaagtcattcttcatccagctttgttccattgctggtgaggagctgtgatcctttggaggagaagaggcactctgggttttagaattttcagcttttctgctctgttttctccccatctttgtggttttatctacctttggtctttgattatggtgacctacagatggggttttggtgtggatgtcctttttgttaatgttgatgctattcctttctgtttgttagttttccttctaacagtcaggtccctcagctgtaggtctgttggagtttgctggaggtccactccagacactgtctggatatcaccagtggaggctgcagaacagcaaatattgcagaacagcaaatattgctgccggagccttcctctggaagcttcgtcttgggggcacccggctgtatgaggtgtcagtcggcccctactgggaggtgtctcccagttaggctacaagggggtcagggacccacttgaggaggcagtctgtccgttctcagagctcaaacactgtgctggtagaactactgctctcttcagagctgtcagagagggatgtttaagtctgaggaagtttctgctgccttttgttcagctatgccctgcctccagaggtggagtctacagaggcaggcaggcctccttgagctgtggtgggctccacccagttggagcttcccaaccactttacctactcaagcctcagcaatgatggacgcccctcccccagccaggctgctgccttgaagttcaatttggaactgctacgctagcagtgagcaaggctctgtgggcgtaggacctgctgagccaggcacgggatataatctcctgttgtgccatttgctaagaccgttggaaaagcgcagtatttgggtggcagtgtcccaattttcccggtatagtgtgtcacagcttcccttggcttggaaagggacatcccccgaccccttgtgcttcctgggtgaggcaatgccccgccctgcttcagctcaccctccgtgggctgcacccactttccaaccagtcccagtgagaagaaccaggtacctcagttggaaatgcagaaatcacctgtcttccgcgtggatcatgctgggagctgcagacaggagctgttcctatttgaccatcttggaatgccacctttttttttttttttttttttttaaggcagtttcttgctctgtcacccaggctggggtgcagaggcatgatcacggctcactgcaacctctgccttctgggctcaagtgatcctcccacctcagcctcccaagttgctgggaccacagccacgcatcaccaggcctggctaatttttgtgttttttgtagagatagggtttcgctgtgtttcccaggctggtctcaaactcctgcgctcaagcgatccgcctgcctcagcctcccaaagtgctgggattacaggcatgagccactgcacccggccaatatgtatgttaatctcatccctcaagctgatactgaagtttttcaatttatgttatttggtgtaaatctaggcagtctttaacaaaattggtgcttcatgtgtttaagaggcataacttaagaattgtttgtttcttataaatcaggagaatggaggtttaatagaggtgaactgtctttctcactgcagaacctttaatatgccactatgcattgtaaatctcccaagagtgagattctagtatgatgcttttcttttccttttctgttctttccctttccctctacctcctttttcttttctttgttggtggcatgagtcctatattataaggaaatgcttttagagtacagtcttctgatatatagtgatttttgaaaaagatttatttattgtcttgttcactgtgagctttttcccccatgtataagcagctgtgtaatagattcaagagcaccccctcgcccctttttttttgagacagagtctcgctcggtcactcaggctggagtacggtggtgctgtgatcatggttcacctcgacttctgggctccagcgatcctcccacctcatcctctcaagtagctgggaccacaggcgtgtgtcaccgtacatggctaatttttctatttttagtagaggcagagtttcgccatgttttccaggctggtctcgaactcctgaactcaagcagtccacctgtctcagcctcccaaagtgctgggattacaggcgtgagcctccactcccagtctcaaatattcttttgaaatatttgaaatatgttgatctctcagtctttcaaccttagttgtatgttgattttcaataaaaaggaagtatttgttgccctaacatcagtattggctattcagtttaaaaaaggagttaaagagatgttatttataggcaggcttcaaaagaggaaagaatgatcagtttcattctctgtttctagcatattctgactccttctctcatattacctcgtttttcccacattttttctttaataaagtgaaattcacataacagctaaccattttaaccacggaaagtgtacattccgtggcatttattaccttcacagtgttacctctacctttatcaagtttcaaaacattttatcaccccaaaagaaagccctgttcttattgggtgcctcttgcttttttttttttttttttttttaaatcttgagacggggtcttggtttgtttcccaggttgtagtgcaatggggcgatctcatctcattgcaacctctgcctcccgagttcaagcaattctcctgcctcagcctcccgtagctgggactacaggcacgcgccacatgcctggctaatttttgtatttttagtagaaacgtggtttcaccatgttggccaggctagccttgaactcctgaccttaggtaatctgcctgccttggcctcccaaagtgctgggattataggcgtgagccaccgttctggccacctcctacttctttcattagtcttaattccttagtggatttgacagtgtttatattatctacaccaatgcatttttttgtatgttaataataggagatatttattgggcatttatttacatacttatttgcatgtgtaactgttgtatagccagtttatgtatataatcttactaaatctctacagtaaatctatccccatttcatagatggtttaaaagaagttaacttccccaagcattacttttagtaagtagtgagactgaaggttgagttctggtctgtcagattccgaagttgtttccttaggaaccatattatcttgtgtacaactcttgggctaatcttgttaatattctttatttgacctcacactgttgattcataccatgtttaaaattgaaatacattacctatatttaaaaattgagacctcacataaaaagctatatttctagctgcttttgaaatttcgaaggatcttccaacacttggctgacattcctgcgtgacaaaaatcagctggagctgtgtaatgtccgacctgtctctgtcaatgaacagattattcattgtcatttctcatctgtttttgagattgtaactttgattctgtataactcatagaattagtagttagacctatatatgttagttattacattatttgtatatgtacagactgctttagacaatattgtagtgttatatgttaattttatcaattaaaatgtgctataggatcattgtagagatcttgtctctaattaacaggattcataaagagaaaacaaaggagagaaacatccagattgaaaagacctacatagtgccaagcacaataaaagaaaccctatactaggcaaattattatgaaatttgttttaggacaccagaaataaagataatatctaaaaactttttagaatcgcctaggagggattaggaatatgaatagcatctaacttgttggcagtagaattgaaggtagaaggtggtaaaacatcaccttgaaagttctgcattcagcctagaattctgtatccagttaaaccatcaatcaagtgtgaaagtagggggaaaaactcaaggactaaaaaaatgtgctcatgaagaacattttttttggacattacccagaagatgtggttcaacaaaacaagggaataaaccaagaaaggaaataaaagagcttcagtaaacagagaatcccactcagaagcaacaaagaagaaagtcccaggatgacagctgtgacacaagctgaaaagttaccagttttgcttggagcaggagattagaacttccgggaaaataatcaaattgatagatggatgttgaaatatttggagaaaaatgtaatggattcttgcaaaactgagcaaattagaaaaaggaaacaattattagcattggtggtttgagttaacccaaaattgtgatgttgctattttaggggaattaagataagtgaaacacgtatggaatactgctagttttgtaagtctcctttaccatggcaggacatctgtagttaataaatctgtaagaagcagtattaagaataatattttaaaatacctaattaaataggaggaaaaagaatccgagtagttgagggtgattgcatctggggagaagcaggaataaaggtttgaagataaatagggccagagatgagtaattttgttactgtgataatatattttatatatatgtgtatgtgtgtgcgtgtgtatatatatatatgagatatatctcatatatatgagatatatatgatatatatatgatatatatgatatatatatataaaacatacagttcagtagcattaacatctagcattcagtacatttacattgttgtgcaattgtcaccactgtccatctctagaactttttcattatcccacactgacataccacacccattaaataataactcctcattgctcctcctgttagtaccaaccattgttctactttcatctctatgtatttgactattctaggtacctcgtataagcggaatcacgtgatatctttttgtaactggcttatttcactaactatcttcgaggttcatccatgttgtagcagttgttagcatttccttccttttaaaaggccgaataatattccattgttatgtatataccatattttgtttatccatttattcatcaatagacacttttggctgttgtgaataatgctgctatgaatatgggtatgtaatacctgtttgagtatctgctttcatttcttttggatatgtacccaaaagtgagattgctggattgaatggtaattctatatttaaatttttgagaaaccaccatactgtttgatatactggctgcccaattttacattaccaccagcaatacactagggttccgaatttgccacatcctcaccatcgtgttgttttgtttatgtttttttttaataatagccatcctaatgggtgtgaagtctcattgtggttttaatttgcattttcctaatgatcagcgatattgaacatttgcacatgcttatttggtcatttgtatatcagctttggagcaatgatgtctcttgaagccttttgcccatttatgaattgagtagtttgggatttttaaattgtgttttagaagttctttgtatactctggctgggcacggtggctcgtgcctttgggaggccgaggcaggtggatcacgaggttaggagttcaagaccagactggctggtatagtgaaaccccatctctactaaaaatacaaaaattagctggtgtggtcgggcgtgatggtgcacacctgtagtcccagctgttggggaggctgaggcaggagacttgcttgaacccggaaggtgggggggttgcagtgagacaggattgtgccactgcactcagcctgggtgacagagcgagactctgtctcaaaaaaaaagaaaaagaagttctttgtattctctgaatattaatcccttattggatatgttatttgcaaatattttctcccataaagaatgggttactttttcactctgttgattgtttcctttgctgtgcaggagctatttagcttgaaaaaatccaacttgtctgttttcttttgttgcctgtacctttggtgtcacattcaagaaataattgccaaattcataccatgaaactttcccccatgttttctcctgaaggtttttatagttttagctctcacatttaggtgtttgatccattttgagttaaattttgtatataatgttatgtaagagtccagcttcacacttttggatgtgaatatctagttttcccagcattatttgttgaaaagagtgtctttttccccattgaatagtcttggcactcttgttgaaaattatttgacaatagatgcaagggtttatttttgggctctctcgactattctgttagactatatgtttgtttttttatgtcaggaccaccctaattttagtactgtagctttatagtaaaatttgaaaccaggaagtatatgtcttgtgtatttatttacttattttttgaaatagcatctggctctgttgcccaggctggagtgcagtggcacaatcttagctcactgcaacctccacatctgaggttcaagcaatcctcccacctcagcctcctgagtagctgggattgtagacacataccaccatgctcagctagtttttgtatttcttgtagagacagggttttgccatattgcccaggtgggtctcgaactcctgagcccaagcagtctgccctcctcagtgtcccaaagtgttgcgattacaggtatgagccaccgtgcatggccccaacttcttatatttcaagatggttttggcccttcagggccctttgtgagttttaggatggattttttttttaacttttaagtttaggggtgcatgtgcaggtttattacataggtaaatttgtgtcaaggtgttctgttgtatagattatttcatcacccaggtattaagcctagtacccattagttatttttcctgagctcgcctcctcccacctggatttttttttttatttctaccagaaacattgttgggattttggtagggattgtattagtctgtagattgcattgaatagtactgacatcttaacaatattaagtctttaaagccatgaacaccagatgtctttccatttatttacgtattctttcttttctttcagcaatgttttgtaattttcagtgtacaagtattttacctccttggttaagttaattcctaagtattttattcattctgatgatcttataaatctgttttcttaatttcctttcctaattgttcattcttagggtatagaaacacaactgattcttcgcacattaaatttgtgccctgcttcttcgcgggtttgtttattctttttttgtgtttgaaatccttgaggttttctgcatataagattatatcatctgcaaatgagataattttacttgttcctttccaatttgagatgatttttattcattttcttaatgctctctcatacattcaatactatgttgaatggaagtggtgaaagcaggcatcctgtcttgtttctgaccttataggaaaagctttcaattctttgccattgactatcatgttagctatgggattttttttttccccccagatagagtctcgctgtgtcgcccaggctggagtgcagtggtgcgatctcggttcactgcaccctcctcctcccgccaggttcaagtgattctcctgcttcagcctcccaagtagctgggattacaggtgtccaccactatgcccagctaattttcgtatttttagtagaaacatggtttcaccatgttggccaagctggtctcgaactcttggcctcaagtgattcacctgcctcggcctcccatagtgctgggattatagtcagccaccatgcctggccactgtgggatttttatatatggccttcattatgttgtggtaatttctttttattcttagtttattgagtgtttttatcataaaatcttgttgaattttttcaaatattttttctgtgctagttgagatgaccatgtgatttgttttcttctttctattaacatgatatattgtttttcatatattgagccatttttgcatcccaggaataaattttacttggtcttcgtgtataatccatttaataagctgtggaattcagtttgttggttctgtgttgaggactttatatcaatgttcctaagggctactggtctatagttttcttttgtagtttctttgactttgctatcagggcaatgctggcctcattgaatgtgttaggaagtgtttcctcatccatttttggcaaaactttgggaaaaaacgatgttctttaaatgtttgatagaattcacagataaaaaaatcacatctagggcttttgtctggaatttttttattgttattattgattcagtcttgttactagttataggtctattcagattttctttttgtgtgtgtgattcagtattagtacattttgtacttctcgttatttctccatttaatctatattatctaatttgttggcatacaattgttcatagtactgtcttctcttttttttaaacttctgtgcagttgatactaatgtccctacttttatttcagattttagtaatttgaatcttctttatcttaatacaggtaaagctgggtcaattgttaaaattttttcaaagaaccagtttttggtttcattgatttttctctgttatttttctattatttatatcctctctaagctttgttatttccttcatcctgctagctttgggtttattagtttgttctttttctagttccttaagatttgaagttggattattgatttgagatcgttttcaattaaatgtgtacaactacaaatttccctcttaggactgcttttgctgttctgtaatttttggcatgttgtgtttttttgttttaatttatttctaagtattttctaagttcccttgtgatttcttctgcgtttaaccgtgtattttttaatttccacagttggtgaattttctactttttcttcagttattgattttattgattttcagtggcatcctgttgtgatagaagatactttatttggttccctgttttttttttaaaacagagtgttgctctgtcacccaggctggagtgcagtggtgcgatcttggctcactgcaacatccacctcctgggttcgagcaattctcctggtctcagcctccccagtaggtaggattacaggcacatgccaccatgcccagctaatttttgtatttttagtagagacagggtttcgccatgttggccaggatgatctcgaactcctgacttcaagtgatccacccgccttggcctcccgaagtgctaggattataggcgttagccaccttgtctggcccagatcctctattttcttgcctatattctgactgggtgtttttgtccattattgagagtagggtatcgaagtgtccagctgttatttcagaactgtctgtttaccttcaattctgtcaattttttgcttcatataattgggtggtctcttattaggcatgtaaatgtttttgattattatatcttcttgctatattgacacttattgatgtgtaatatcttttttgtctcaaccttgttttgatttagtttgtctaatattaatgtagctacctgcactctcatttggttattacttgtatagaatgtctttttacatcccttatttgtgtctttggatctgaaatgagtctcttgtagacagcatatacaatctcttgtagattgtgtttttcttatacattctgtcaaactctgccttttgattgaagagttttatcatttacaattaaagtaattattgataaggatttaactgctgccattttgctgtttattttctatatgccttacagcttttttgtccctcatttcctgccttactggcacttgtgtttagttgatattttgtggtgaagtgttttaatttccttgttatttccttttgtttatattctgctattttctgtgtgtgtgtgtgtgtggttgccattgggggtcacatttaatgccctaaagttataacactgcaatttcaatttataccaatttactttcaatagcatacaaaaattcagctcataagattcagtccctgctcccttccagttattgatgtcataaaattacatttttatgtattgtgtgtctaaaagcgtagactaataattgttttttaatgcagtagtgtcttaatttgtggaaaacaaaaagtggagttgtaaaccaatgttacaataatgctagctttggtaattgctcatgtatttatcatttctcagatctttatttcttaatacagcttcaagttactgtctagtctccttttatttcagcctgaaagactcacttcagcgtttcttgcaggacaggtctggtgataatgaactctctcagattttgttaatctggaaatgtcttaatgtcttcatttttaaggacatttttgctggatatagtattctcagttgacaggtatttgtgtttatttgtttgtttcctttcaggattttaaatatatcatcccactgccttctgtccttcaagagttctgatgagaaatctgctgatattgaggatccctttgtatgttacaagttgcttctctcattccatgttcaggattctcttttttcatagtttgattataatctatctcagtttttcctacttggatctctgagtttttcctacttggagttaattgagcttcttgaatatttatattcatgtctcatcaaatttgggaagtttttgattaatatttcttcacataatcttttttgccccttttctctctttttattctgggattcccagagtgtgtatgtgttggtccacttgatgatggtgttccacaggtgtcttaggctcttgtcttcaattttccttcagttttttttttctgttcctcagacacgtggtattttcagctgttctgccttccaagtttactgattcttctgcctgcccaaattggcttttgaattcctctagtaaatttttatttcagtttttgtacttttcagctccagcatttattttttgatttttttatgttttctctttattgatatttcaattttgttttttgacattatccatatcttcctttagctttttgagcacctttcaacatttgttttaaagtctatgtctagtaagtgtctgccatctgatcttctcaggcacagtttctgttaatttatttttttccttttggcctatacttaatgttttgcttggggtagtttttttttttggtatgctttgtgatttttgttgttgttgtcaaaaactggaatttgaatcttaaagagtggtaactttggaaattagatttttctcttttctctaagatgtgctattttgtttggtttttttatttgttgtagagtatttctatgctgggtgtaatcttaagatcttctcggcctgtgtttttccctgggcatgtgtagtgactttctaaattgccctatgtatgcagttcttttgcagtagtatcctccttaaatgtttggctcctaaaaggcaaaataaataaataaataaataaaaattaaaaattaaaaataaatcaaaggggtgaaatagctctggatctttaaatccctggagcaattttttcagccaatggcagttaaataatgatagtctgcctctgtgtcacattttgatcagaagcagcaattagcaatcagaacacagattcctgatatttggagggcaaggtctttgttgccaaccttgactcttacaaactgtgtgcagggtgctctgggaacatgtgcatggttgcctgctttgagagtgggtgatgggtagccgcgacggcacaaagagctgaaattgactcaaactaactgatttaccattcaagtctttccttagaaactgaaaacctgaatagactccagagttccagaatcacagattctgcttacagtcgtctaggtggggagatgggttcctggtacttctgattctgccatctttctttgactaattttttttttttgttcttgagatggagtcttactctgttgcccgcccaggctggagtacagtagcatgacctcggctcactgcaacctctgcctcccgggttcaggcaattctcctgcctcagcttcccaagtagctggaattacaggcgtgcaccaccatgcctggctaattttttgtatttttagtagagacagggtttcaccatgttggccaggctagtctcgaactcctgacctcaggtgatcaacccgcctcagcctcccaaagtgctaggattacaggtgtgagccactgcacccagctcttagacaaattttttattccaaactttttttattttatcatttgaaaggtatatgtttattattttgtcaaaaataattttaaaacgtattcttgaagcttatttagatctgtttcataggaactgtgaagaaagtaaagaatttaaaaaatgaagacagattttctcaccctgcttatgggtgcttctcgtgctagccttttgcaagtgtcgggaagtgtaacctgcaggaggcatcagggctttgggcctgcatggtctgagtgctgccctgtgagtttcagaaggcgcagcaacctgtatacctgaaagccatctctgctggggcaggtacctagtgtccccacctacctgggtcgtagtcaggccctgggcaagcctgctatgcttttccttccctaatccctcaggggtgggatagagagcacagtggcctcccagggaggtagaagctgctccagactaacaatcagagctgccagttcttaatccccaagaccgccagacttcacaaagacataccgaggtctgtgctgtcagtgccccactactacactcccttaagtagccccacattcttgtgcttgtttcttttttctgctctctttccttgcccaggtaagaggtctgcccataagggatattttgcagcatgtgaagctttttaaaaagttaggcttattgaagtataatttacacacaaagtacaaaaaaaaaaagactgtgttctcaaatctgtgagtcattaatgggtttagatgtttatatattgaaattattggaagtaaggtatgtttatattagaaagatttgtagtctagattatccaagttttgggagtattacctctctgcttttgtttatctacttttttagtctctactttccaagtatctataggcaaattttcccatttccctttggaaagtgctgttttcttgctttttttccgcctttccattgtgtcagacttataaggcaatcagccaactgtgggcatgaaatccttgggaggaaagagaaggaagtgggaggggcagccatggtgaatgtttccctaagttatagtcaagttctttgagagaacataacctcatcccctttttaaactgttgtaatactttcttttaaatagattgtttattctcctgcaagtctcacagttgttcacagtggtaggtaagaaatcataaagttcaaatattaaagggagctcacaaaagagcatggtttcaccagccctcactaaaaacaaaattatgggaaaatgctgtaaaagaaaccagaattcttggttgcaaatgatagaaagtgactctgatttacctaatcagaaaggaatttttaaaaaagtattaggtaggtggaagctaagggaagcaagacatggccccaaggtttcaacaggagcaatctgcttaggactttgctgcttggacacttggtgtaatagctgctgccactatgcctcgaaactggtgactctgctcattaactcacctcctctggtgatctctaggaataatctctgactctcctgtaccttgtcctcactaggattcggtatccacggcaaaaagatctattaatagttggtatcaggcctgtacatgtgttaagagaaagatgaggaaagaagtatctgcttctaatctcttgaaattatctccaaattgaaatggtattttggttgcctaacagcctgaagatgacaaatatcccctacaaatttctcctattttaccctcttcctaactatatctgtaatttaaagtttcacatattcttttgaaaattgttttcattgtttacccactttttaagaaaagcaaatgggaacatactaccactgtttggcccctttcaaaaattttatatctgaggaatcttccatattgttgtggacatctacctacctgattcttttattaactaccttttatttcattttatgatcatgctatcattaataggcccctatgatgaatatataagttgtttccagttttttttttgtcattgagaacagttcacatatgtatcttgttgtcttttccaagtatatctttaaggcaaattcttagcagtggagttgctaggtccattgcgtctatggtttaaactagtgccttcaaaaatggtattttatatactcactgtttaagagtgcttcttccttctatccccactaactttggcaaactgaatagtttcaaactttaactttttatagcttgttggcaaaaaatggtatcttgttatttgatcgtgtttttttaattgtgaggtttagcgactttttgatgtattggtcttatgtactttctggtgtgtgtgtatgtatatactgaccctattttcaacttatttttcttttagtttgtttgtattttccttaatgattttcaggaaaccaattttattctttcttcagacagttgtctaatgttctgcttctcttgccatttgaattttgtgactacaaaattcagatgaaacaataatagcataaagaacttggtgggttatcttttgttttgcattattgattgtttattaagaaatattctttaaaagtcaccttgcttaaattagcaagtaggaaatgctttcaataaagagaactgtcatgtacccactactccttacttactgaatcatcttcttttggatagagaagataaaagtgaaaagggaatttaagagttcctgcctttttccttgtctttagcattatatagctgtttaatgtgtgggagtctaatttcttttttctttcttgagacaaagtctcactctgttgcccaggctggagtgcagtggcacagtcttggctcactgcaacctctgcctcccaggttcaagcaattctcctgccttagcctcctgagtagctgggactacaggcatgtgccaccatgcccggctaatttttgtatttttagtagatatgggacttcaccatgttggccaggctggtcttgaactcctgacctctagtgatctgcctgctttggcctcccaaagtgctgggattacaggcatgagccactgcacctggcctaatttttttattgttctttttggtgtgaacattctcccctcctccaagccttttgtttttactattttcatgttcctttatatgtgctgctgttttgtttcatctgtaattatctctcatccccttttttggctattataatatatatatgtacgttttgaatctgagctttgaaggtaaattcactgcagctgtgttggttgattttagataatttgtgtatttcctcctttgtcttttttaaactggagtcatttgtagttgtttatacagaattttagtttttaaaaccacaagtctttcattataggttgagttatgaattcatagcctgttatttaaatgaagcttttgaaatctgttttactgatctgtatcatatctaactacgccagtatttccttccttgtctgacgtgaactctaaaattatgtgaacactttctccctgtttcctggcatttccactcaaacttgttcctcattcttagttagaaatatatccagaattgtagtttctttctaatctaatgacagaagcaaattaatcaagcatggcaagaatttattggaaaactgcatgtagttgaaaatatgtttagtatatattttgacagctgtgaagtctctaatttttactgtaccttttctctgttccaattttatgctctattctaaggatgtacccatttctactacctgactagggagcatgtgtattgtatcccagcagattttttttttcatagatagatatcctttagatatctgttatccagtgtaggtagccactagccacatgtagctatcattatgtttaaatgtaaataaaataaaataaatttactgagttgtttttgctagctacatttcttgtgctcagtagctacatgtggcttgtgattactgtattaagacagcacagatacagaacattttcattattgcaaaagttctgttagacagtgctgttctatacagtgtcattctgcctctcattctaaaaagttctaattcctgaagttgatgtactctttctgttgctgtcctctagcttaatcaaaataaatttgagtctttttaaaggtaggttgcattttacatactgatatttctaaatcagaggctatttatattactttttttatattacttttaaaaattagctttattggagtataatttacatgcaataaaatctacccattttaaatgtacggttcattgacttttgagaaatacacacacacacacacacacacacacaccttcttgtaaacacacaccttcttgtaaacacaacaaccaagatttagaacactcgctttatgaaaagtttccctcatgcccatttgtagtcagtccccaaacctggtttcaggcaatctctgatctgctttctatatgctttgcctatactaggattacatataaatacagtcatatagcatgtattcctttttgtgtctggcttctttcttttagtataatatttttgaaatttatccctgttgttactagtatcaataatttgttcttttttattgctgactaatattacattgtatggatatgacatttctttattagtgtggtgggcatttgagttgttttcagtttgggtctgttatgaacaaagctgctgtaagcattcatgtgcaagacttttgtggacatatatttttgtttctgtttattcaatacctttgagtagaattgttgggtcacatgatgtagatcagttgaacagagtagattccagaaaagttcacatacacatttcttgacaaaggtgctgagattattcatgggaaaaggataatcttttaaacaaataatactggaacaatagagaaaacaaagtgaaccttgacttttatgtcttatcatatacaaaaattaatttgaagtggattgttgacctaaatgtaaaagtaaaatttaaaaatataaaacttctagatgaaaacataggagaaaatctctgtgacttttggtttaaagatttcttagacagtacatataaaattaactatataaggaaaaaatggacaaatttgactttatcaacattaaaaatttctgctcattgaaagactcaaaatgaaaaggcaagcagttttggagaaaatatttgcaatacatatatctgaaaaaggacttgaatgtataatatatacataaagatgctcttacaacttcataatgagaaaataaccccataaagagaagggcaggccgggtgcagtggctcatgcctataatgccagcacttttggaggctgaggtgggtgaattgcttgagcccaggagtttgagaccagcctgggcaacatggtgaaacccagtctctacaaaataaaaaaatacaagaaattagctgggcatgatggcatgcacctgtagtcctagctgtttgggaggctgaggtgggaggatagcttgagcctgggaggcggaggctgcagtgagctgtgatcgcaccgctgcacgcttgcctgagcaacacagtgagatcctgtctcaaaacaaacaaacaaaaaaaaaaacaaaaaatggaaacagaaattttacaaaagaagatatatagatggccagtaggcatatgaaaagatgtttaaaatcagtcatcagggaaatgaaaatttaaacgtaatgagatagctcatatttactggaatggctcaaaaagggcttacaggaattggcaaagacatagattaactggaactcttatgcatgttggttagagcacaaaatgatatgatttcttgggagaaatatttggcagtttttaagattatttttgatagccttctgaatttcttagtgagttataggtcagttctgccactgtttctttcttttctttctttctttctttccttccttcccttccttcccttccttgcctgtcttgcctgccttccttgccttgcctgccttgccttcctttcttcctttcttccctttcttttctttcttttctttttttttttaaaggagtctcgttttgttgcccaggctggagtgcagtggcacgatcttggctcactgcaacctccacctcccgggttcaagcaattctccctgcctcagcttccccaatagctgggattacaggcgcgttccaccatacttggctaatttttttaattttggcagaggcagggtttcactgtgttggccaggctagtctcgaacacctgacctcaagtgatctgcccgccttggcctcccagagtactgggattacaggtgtgagccactgcgcctggcctggcactgtttatttcttttccctccagttttatacctatttagagagattagattttcttgagtactaggaatcactatttttgagcagaattattcaaaactgttattattttttctttaacttgaggcaatgtaggagaaagcagtactgtgcaggtgaaagttacaaacaagaacattttaaacaagatagttactttccatgtattggatacgtaacagaattaattctaataaccatcctgaagatggtcaggaggcattagttaagaattgaaatgtttggagcttgcctgtgttgatgggattaaggcagggatgatttatgtgtaaatttatgcgttagtaacagcagtaaccgctgtagttacactagggttctaagagcaaatgttgattaaacatgaatgtagcaggagtgataaggtttggctctgtgtccccacccaaatctcatgtggagttgtgatcctcagtgttggaggaggggcttggtaggaggtgattggatcatgggagtggtttgtaatggttttagcactatcaccctagagctgtctcgcgaaagagttctcctgagatctgcttgtatataagtgtgtagcacctcccctctttgctctctctcttcctcctactcctgccgcggggacgtgcttgctttcccttggccttctgccatgattgtaagtttcctgaggcctctgattaaacctttcttcttctaaaagattacccagtctcaggtagttctttatagcagtgtgagaatggactaatacaaggggaaatatatatggttaccaaatagcgaattagccatgggaaaaagtagcaaataaataattattttactttttcagatgctaatttttcttttcgtttattttaggattggtgggagctgtccaatgtccttaggctgttttccaaatgagataccaaaagctagttctccatcgggtttctcaggctgctagaagcattcattattatggttgtcattacttcgagttctgttgccgctatgcccacagtagtatttgttacataacaggtgcttgataaatatttgctaaatgaatttttggaaaatacaatctgccacacctttcttctacagtttacaatcttctgttgagatcatccgatagattttttttcttagatattgtacttttgaggcctcaaattgctgtcttttgtattttctatgtctgcagagactttccatctttcactcattgtattcattgttttttaacatctttgtacatatttatagtaactgttttaaagtcactgtctgttaattcaaacatctggttcatcttggagtctgattctattgcctgctcttttttctttgtaataggtcatgtttttctgctttgcctgtctagtaaattttaatcgtatgttgaaatgtagggagtttggattgttacttcctttaagggtgctgagtttcattttgtcaggcatttaaattgatagttgatttagtattgtcaggtttggttctctttgttaaagcaggcatttttcagatttgtcttttgtcctagggcatggtttttaacttcaaggttgccctttccaatgtctcagctaagtatctggggtgttccatgaggtctcttccactttgcctaggccagaactccagcttctcccagtattatatttcgttacctctggcgtcatctccgttatgctttcagatcctgcgcatagacagcccagcccccagccaaggacctgagatgaaatccatacaaaattcttagtcccttgctccacaaactccaacagccttagcagtctaatctcttcctgtttacctcagtgaaatctgtgttccacttgagttccatttccttctgtatcagagaagagccaccatgctgaaagcaaggggcactatgtttctttgttcttaaggatggtagcctatctgcaacaactgtagtgtgatataaaaatatataatttatgttgctgacagttacaaatactgcttgcagtactttgtaacataatttttcagattcaagttcatatactctttttttccacatcaccacacacatattttcagacttcctcctcatccttcttcttgccagtagttgtattataattcctgccagtagttacattataattttggttatatcaatattgagtttttatgggattataactagataaatgccattcatagttaagtgatagagtatattgtgacttttttcctgcatgttttattttttctggacttcacagttgtctctcttttttttaaaaaaattagttttcaatgttcttagctttaattcataaactcacccctaattgtataaatctctcaacatgtttaagcacatttggcattatatcaattttatcttttccaggtgccttctaatctgtcccagtctggactaattgttcttcctggcttgctgtatggctgtctactcaagatgtcccttcaccatcattctagggattcccttttcctctcttgtgggttagattcttcagttcttggagactgtcatcttctttcatggtttcccactcttgttttggcggagcacatctttagtaacttcctgacaaagtgtatggtttgagatttcgctgattttaaaatgcccttattatatagtcacacttgatttatagtctgtcttggtatagaattctaggctgagaagagttttccctcaaaatcagaaggttttgcccaattgttttttagctgctagtattgctgttaaaaaggataatgtcattttgattctagattcttttatgaaacctgtttcttctctggcagcttttaggatcttctgtttctttggtattcagaaatttcatgagatatgtgtgcttctattttggtcttattttcatctgttttgccaggtactcatgcaactttccagtttgaaaactcacatccttcacttttgagtatttttcttgagttatgtcttcggtttcttctcagtgttctctgtttctggaactcctaaaatatatttaacatcctgaactcttagtttttgtttagtcttctgattttcatttgtctttttattctgtatattctgttaattcctcggcttcatggtcttctagcccttcttttgcctatcttatggggttgaggattaaacagtttatatacctgaggtgcttaggatatgtctgtcatatagtaagtgcttgtgttagctgtaattgttgtttactttcataactgtcttgagggaaaggtctttggtcttgattctttgacttcttggctgtacatgaccttggacgagttatgtaatctctttgagacctacctccctcttctgtatagtgttaataagctctagctctcagatgtttgtgagggtcgaatggagtatatatgtgaaaatgtttaatacctttgtacagaattaatagttagtacgtggatctttcaaatatcaaaagttttcagtttgatgggaaaatgatgtctgaattttcagggttatttttaagagtacttgattatgactgtcttgtaaatctctatgagctaggtatacttgcactaaatgctaatgctttttaaagaagttatgtcttaatattcagtctcattatgttaggttgaagatagaagattatgaaaatattctctgaaaagctctggttttacttcagattgtataaatctgtgtaatgtaataattatttaagaatgacatgattactactctaaacccatagaaggggtatttgttggattatttattttcacttaaatggtatttgagattaggaaaaagaaaatctgtcttttggtttttcttgatagtattaatgtaatttcaaatgttagctcatttttgttaatggtggctttttgtttgtttgttttgttttaaggtttttggattcaaagcataaaaaccattacaagatatacaatctgtaagtatgttttcttatttgtatgcttgcaaatatcttctaaaacaactattaagtgaaagttatctgcttgttagagtgaggtagagttaaagatacattttaacagaattgtattcctaaaccgattaagtcaagaagtccaagagcattgttagatcatttagaaagtgtagtgatgaggtaaaacattgttggcacagattcatgttacttgatctgctttaaatgacttggcatctagcccatatttgagcccataaccgtgtggtaatttgaagtgtaattcacagtagagcttctgttaaagcactaatagcatcttccatggaggtatacttcagagtgaatataattttgtttatcctgtgtctctagagctattgactgaaaaagctgttagggcattctctaactgtacatcacctaagttatttaaaattgctgaattaggtggcttgtcttgtctaggacagagttttaaggactgcccacctgattgatagagctagttgaccttatctttaactttttgtttttcttttgactttgggagtagagatgtgaaaaggtaaaaaggaaggaaggaagagaaaacttaactctttttgcccatgaagactgtttttccttctcaaaatattgactattttctgatttgtaaaaatcggcacataaaacgtgttattttttacttgacttttatctttcccatgtgatatctataaattatagataggaaaaatttatctgtaatttagtgatctttctagtgtgataaaacgtcagaagtactgagagtggagtggacattgatattgttactctcagtaagttttcactgatttttctcagagtcatgaaggaacaaacgtttgttaagtccttatcacttattagataacacaaaacatgttgggggggtgtgtacagaggtgagtaagatgtagctcccattctcaagtcgcttacattctaatgtaaaaggtagacaaagcattacagaagaagtaactctgctatagaaggttgcaatgaagagaacattggaaacactaattttaccttataaagaaggtttcataaaggaaggcaagtttgagctggggtgaaaaggaccagtaagggttgactttcaagccaaggagaggaggggaagtgatgttacaggccaaaggaatggcattgtaagaagcttgttggcataaaagtgtttagaatatggcagcgaattcattatcatcagattgtggtgtctgtatgttgggggtgggagagaattgtggtggcaataggcaacaagataaaagaaagtaaaaggtgttatggaaacttaatgggtccagcttacaaatgatctatgcatttaggggtctttctcttttcctgataaacctctcctacaaagagccttgttgcggataccatagtgtttctttggaggaaaataaaaactacaaagctttgtattttttgcacaactggattcagaatataagtaataaaaaaggacaagaactttcaaaagctagaagccattaaactgagtcacttcagggttagactatcagaactggggatttagaaagtctcagaatggaaatcgaaggacaccaaagacaaattcggcctttttcaaaattttattctagtttaacatattcaaagaaagggaaggaaattcttttcattcctgtgtgtagtgacttcctgctttaagaacttaggacttcagctgtactatcagtattgtaggtcacttaacattattatggttaaagttggcattggagagagcctaggaacctaactgcctgtttgtttttatatttccaaccattggattcccaagttaatgaagtctgtttattagttgagggtagctcttaatgcatatattttaatgccccttccccacatggaatcataagctttcagaactggagagtacctgaaagagatcatttagtccaaccttctcattttacagatggggaatctgaggcctagagaagttaagtgagttgaacaaggtcacacaggtacatatggtagccgaccatccactgtttatgccaatattccctttacgttttgcttttttgcttgttcgttttaacctctccaaattttactgacttcagaagtttctagaactaagttatagcatgttttgagttctaatgtcactttccgatcttctttaccttttttctacctctgtttgtatttctggttctggttaagtgagtctggtaagcagcaggtgttctattttatttcttttatttttaggatagtattacatgtgatatatatgtctttgcaaacatacataatttgaagatcttaaaatatttgcactaggcatacccacatttaatagtatgttaaatcttttatagcaattatgatatacatgggtgaagaagagttcctaatatggcctttctgattaactgtatctgtttatatctgtgttttcttcaggcattcataacattaagcaaattcaggtgtactgttacttaattgaattaatcagtttgttttgtacaagtatattttatttttgttccttgttgtataatctggtaggaatggggaaggggagatagtgaataaagagatgtatacttcttgcctttgaggaatttaagttttcactgtataccaattttttaaaggtatttactatatttcagtgcatattttatttgacatactttatcattttgtggtaaacctttagctttactaattttcatctattaagttttcttttgtaagatggtgatagcttcatcaaagagagtaaagaagagacctgcctacctagctgattctatggcaaatctcacttctctggaagcttttcctgttaatcttattccttcagtttctgcctcttgtttcataaaaactcattctttaaatgcttattcatttctcttgtctcatataaaccaatatgaggtactggtatcttttgagttttagttataaggaagcataaatggttaaatttaaatggctaaaccccatttgccatttgtgtatctttaattttagtttgttgagagacttatcactaccaaaccacaaagaatttaaaagaaactgtcagtaggtataggtggaaggagggcatttatcagagattttaatttaagaagaaagtcttcatccttatcctaccaacccccattccctgagcatatttatcattactagtcccagcatatttgctcccatatttcctatgcttacctgtgaagattttcataactttttccttgctttttactgtcactgttggttctgtgatttatgacagatactgctcttgtaggaatgctggctttgactgaaatttgttactgcttttgtatttaaaactttttttttattataagtagaattatggaacagtagtagaaaaagtttgacttttgtaatcagagatactgagcttgagttctggctctttcatttgtatactgttatttggggcaagttttttaatgctcttaagtcttagctttctcatatataaaatggagataataacagttatcacgtgattgtgaggatgaaacaaaaaaaagtggaaactctttgtaaggtgtgttcatctggttgacacttagtagtcattacttccactttccgtccatatagtcctcttaacagtaatatttgagaggcatttttattaaagcagtcttaaggagtgttcgtcaaaccacatgttctgggatcctgagaaagtaggggaagtttagagaactgaagctgcacaaaactaatgtttattttctgttgtgttgtcctgagaccagcttcttagattgtgtttcctagtcctacatctctgattccttataaaatattccattatgaattcttcactattgacaatttctccccttttatcttaaaagtaccaaagaaagtgtaaaatgtgactgtcttgtcagtcctctttttcctgtttttcatgtcagtgggtatgaaattactagcaaggatgcatatatgtgcatatgtcattactaaatgcattttctttctagaaaaactcaatatactaaattgtactaaaaaggaaaagcttgttttgttttgagtggtagtatgaaagttgttttattttaggtctgaccagttagaaaccaatggattgtagtttatttataattagttaaaccttcatgtgaatttggttttgaattacctttaaggtagagaagaaactatatagatgtttttcagggtttctaaatgtacaatacaggttcacaatcacttatttgaaactcttggggccaagtatgtttccattttcagaaattttagttttcaaaaggtagcacagataaatatacttttacataaacaccccagtggggtgtgggtcagtacctgaaatgaaatgttttactcttcgctctaagtgtattaaatattatgtacaatcttattacttcagatcaggatttgctgtagttgagtttgccataaaacttaagagaaaattttagatgttttgaacttttgggatattgaaattgcaggttaaggagctatggacctttatttgttttaaaatgctaagagtttattttaagtaatttttaaaaaatttgttttgcatagtagttggagttaccagggtactgctaaccacactgatatgtaagatctctttctgagccttttattgtttgtaaacatggcctgttaatcattagaaagccagtacatactaacatatcactgctattaagacaaatattagcatactctagtaatgacaagtcagcattttactattctgtattgattttacttattctttcattactctcatactgtaattaaaacttgcaatctgagagactgttgaaaaaggtgatcgttggcttttcaacagggagtaaggtctggtttaaaaaaaaattagtaagcatttggccaagtagattaacaacattcagtttttctttactgtccttatgcttttactatttttaacatatatctttttgaagaatagtttgagaattatgtatgcttaactatgagatacagatactattgaaactagtcagttgtttataggtacttgtaaaattaaaaatatattccaatagcatgcagatttttcatagaggaaatttgaaagcatggaagcacctgaatttacagtactctgtattagtggcatcacaagtttttaagcaaatgtattagctctaattgcatacacttaatcttttaagctttggttttattattataatatgggggtgataacagtatctacttaatagaattcttgttattacatgaaataattaatgttaaacacagcataatatgtgtcacattataaagattcaggcaatgtttgttagtattagtacttttttttcttcctaagtgcaaaagataactttatatcacttttaaacttttcttttagttgtgctgaaagacattatgacaccgccaaatttaattgcagaggtaggtatgaatgtactgtactatgttgtataacttaaacccgatagactgtatcttactgtcataacaataatgagtcatccagattatcgagtgagatacatatttaagaattatctttaaaaatttcaaaaattttaattttactgttgtgttttaggaaaaagtattgcataaagctattaatattgtcaggaagactaaagtgcagcatagactaagaattaggaaaattcctagactaaaaatagtataaggagagggtttacctactatttgaggcagttggtctaatagtaagcaatcacagggagaaagcagaactacttaactcttctgtgttgaggaatgacataaaaggtaggaaaggatataacaaatgttgataagaggagtctgatggatgagaggagggaactgctttaaatgagtttctacttcagacataagttaattctcagagcccacaaaaactttcacttttatttgtgaaatacaactcagttctcatggcttaacactttaaaccatgagaaaactgaagagttgagaagcttggcagatgctgctgtgatagtcaaaaagaaagtgggtgccatgagctactattgatgtatttgccattgatccctcctgaaaatctagaatggactttcagacaaatggtttgaaaattctaaatcactaatgattgagatttagtataggtttactaagaacgggttttttttgtttttgtttttggtggatttaggctgttgcttactaagcaaagcaggctttagttgaggtttatcttgctttaaacagatatttaacagattttcctggaggtttttgtgtaccactgggaaaatgaagttaggcagatgactaagtgaaagctgtcctgctgactccttataatgatagtcattgtctaccagaagatctctcctgtcacaccaaaggataattgattatatcctgtaccatattatgagtcacctgattggagatataagacatacttctcacatatttagatgacacaggttagtacattgaatatcagccagggtttttaaggatcttaatagagtggaactaaggtagaaactattaagagcaattaatagtgatatatctatagtcctgtttctaaacaagtttttttaaaaacctcaactctgactatagtgaacagagaagtcttggactcttacaattcatgtgagaagacctgaaactttgataacaattatatacattttgtgagtaatttctttggtgtatgccttcacatatctctggtatgtgacctatgctgcagtccattgagcatagattcccagaatgtattctcctgcagaaaatggaggaaaataatacttggcttccctaatgattacatgtgtatacaacactaacatttgcaagaccacctttaaataacacacttagcatttttattttatgaaatgtaatatgtagttctttgcatagtttatcctattagtaatctattctgtctttggaatatgttttgtgatgatgaaataaatactataaatagtattattccttttgcattgagagtcctgacgaaatgtccatgtgacagttcattttgggtttagctctacctctaatatgtgacctatgctaccagtccgtatagcgtaaattcccagaatatatcctcctgaataaaatgggggaaaataatacctggcttccttaatgattatatttaagacttatcaagagactattttctatttaacaattagaaagttaagcaatacattatttttctctggaatccagtgtttcttttaaatacctgttaagtttgtatgcaacatttctaaagttacctacttgttaattaaaaattcaagagtttttttttcttattctgaggttatctttttaccacagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaaggtaagttattttttgatgtttttcctttcctcttcctggatctgagaatttattggaaaacagattttgggtttctttttttccttcagttttattgaggtgtaattgacaagtaaaaattatatataaatacaatgtataatatgatgttttgatgtatgtgtatatacattgtgaaatgattactacagtcaaactacttaacatattcatcacctcacataattattattctccccccagggtgaaagcatttaagatctacaagctacaattttcaattatacaatgttattattaactatagtcactatgctgtccagtagagcttcagatcttgttcatcttgtgttcctccctccccaccctcagtccctggaaaacaggttttaaagatagttgctaatccttatttcttctaaatttttaaatcagttgctgcctcaatttctatatgagaaatgactgattgatttcatttttctgttcacgctaccattttcatatcatactagcacatgttacccattaactgtattgcagatttggtctcacaaaattcttctaaaataacatttttaaaaagcatattaatcaaaaataagctttatatttctgaagcttgtttgagcatagaatgcctttggataaaataccattacctagtaaagtgtgaacttttataatccataaaaattattcttttataagaatattcataaatgtagttagattaatagaagattctcgattctttgatcagaaaactaaggactatattgaaaaatcagtgacaaatttaattcttatagtacatctgaaagaaaaaagaaaactcttgggagaacttttacagtgatttaattttgctgttgatatatttctttgggtggtaagtatggcaaaacatgttaaaatttaatgcaaagagattttgtacatttttccatctctaagaaggacaaagcctaagcccctccagatagatagaaaaactcatttagagagttctccttcatgttaatctaatttcttcttaattcagctgtaaaacagaaatagaatgatcgtattaatcatttaaagctgtgtaattgcatagattccttgttcctttaccccctcttatatcttgtttcctatcctttgtgactttttttgcattatatataaggatgccgaaatactgtttattgttgatagtttacaaaattgaatcttacattagtgcataattttggtgaatgttgaagattatggtagattgccttacatttctgcatattgtttgcaccttggaatgatagcactggcatgaattatagagctgaggatctaaagatttttactttgatttatcccattatcatctgcagggaaacaattgcttttactgattaaaaatgcaggctgggcacagcggctcacgcctgtaatcccagtactttgggaggccgaggcgggcggatcacaaggtcaagagatcgagaccatcctggccaaccaacatggtgaaacctcatctctactaaaaatacaaaaattagctgggtgtggtggcgcgtgcctgtaatcccagctactcaggatgctgaggcaggagaatcgcttgaacccgggaggtggaggttgcagtgagccgagactgtgccactgcactccagcctggtgatagagggagactccatctcaaaaaaaaaaaaaaatgcagtagcaaaagcgatggtagaaatttaaaacagagttgatgagcagcatatattttggtagtggaaaaaaaggtaaaaaattttttgtaataaaatagaaaaattttgtaatgtggaggcgcagaacactagatttaagccagggggtcttaaattgtgttacattccttttaaagtctgatggaaggtataaatgttctcccctcaaaaaatgtgcatagtgtacataaaattttgcagtttttattacattgaaatatattcttttagacagaatgtaaaagaaccttcatgaaaactatgtcacttttttatgcaaaaaccagtggctactacatgagagcaatgaataaatctaagtggtacaaattaaccaaaattaagctttagttctgttcaatactaaattttaatgaaaagactgctatttaacttttaaaataacaagttgaaactatgctctttgactttgactttgcaacttttatatgatctttgatatccaatcagtgttgactttggtaaaaagtgctgaaaatgctattttacaaaagaaagaagagtaaatggaatctgtagattctattgcctgatgaaagtagacgtgtcaagaaataagaattctccaaggctcttcagataaattcatgtttcatcattttctttgccttcaagttactgagatcatttttggcaagatctgtatcattaatgctgtgttaggaaagaaaagattatgactccacattttactttcaaggttgaagagttaaactgtttaaaaagagtgtatgttatcctgtaaacagcagtatcaggctgtagaatttgtcttctgaaagcagggaacttatatatagcaaagaacttcatagtgctcccatttcttgacaaaacctctcgagaagctcttgattgaaagtcttggctttcatgaatctggcagctttcacaatagtggatttttcatgacaaatcatcttacacagggaattattcaagggttggcacttgaaacagtagaatactttcacaacaagagataagatttctttcaggattgatgacagtcttgcaccctagcgcatactgatgaagagagcagtgggtgaccatgacatggagagcttctgtctttaccagtgccccaatatcagatgtgttgtctggcagtaaggtgtactgtctgcctacagaatactgaggtttcttcaggagaagttttttggtaaagaaactttaccattttgaaagtgttaatgttttctgaagcttccaaaaagattccaaaatgggaatgtttccttgattgtgtcaccatgcttgcatttgatgaaaacttgtagccggctatactgagaaatcatatctgaagaaaggtggtacttccaatctttttgtgacctactttattattgtttttttaatgtcagggttttttttggaatggagaaaagtatttgatagaggtattgcaacagtcttattcttcttcatgctacaagtatatttgactctttctaagatacttgccttcactgttcaactgtgtgactttttgtttgtttagcattacaatcaatatcctagtaggatgatttaatcaatgatttttaattggaacaaatagtttttgtaatggtctaggcttttccaacttaactgtgctctcacatgtggtctctttttctccctctttcctccttcttatacactctcacccacacacatatgcatacataccctgtctgatgtatctgcttcttcagaatagttggctgtgctctgctgatgatgagaacttgccatttaagaaggacttgggatagtccatgtcatcatgttcagggataaaagtaaaacccaagggcatttaaactttattgtattttattttctgtttccagtccaaattaaatccaagagaaggctccataatcaaaaagtaaggacatattttaaatttgccaatgggaagatattctagtcattacagtctggtaatactatcaattctgtttctcttcagaggtgaggggagactatttgatgaaatcgtaagtcctgtagggtgttgtgaaatagggccagaatgaaagatagcaagaatagtgttatgaaaataaaatgcaaagtttataatatcatgtggtaaaatgtaatagtatttacttcatcagtagaactgctctagtagctgtatattctccatccttgcataggttggaatatcccccaagtgaaaagagattgatgggctaatagttaatagaaaatggagatctgtacatacagtgttaagaatgtagatattaaaattgttatatttagctgttacataatattaagactcagagttaagtaatttcactgaaattgattgctttttgtgtcttggagtcaaaataaataactgaaatctactatacttggctcatgcttaattaatatacttagaccatatttcggatgaattattcacagaatctaaaggagtatcctcgtgttcttaccttctttatccctgtgtttatttaaaaaggcaaaaaaaatggagcagatgctgttggttgaccatattttactgaacagtagcatttgtgtttaggttgaaacagcattagaaaactagatacggattaaagtcagtggtaggtttttttttttttttcttccaggaatgtttcttatagatgatcaaacaggcacaggaaggggaagtgttgtgatcaatattatccagttaatattagcattcagaggaaaatttgagtcctctgatacactgttaaatttctttctatactatcaagtccacaaatcctggaactgcaaaagaattttgagactgttcaaaataattaatctctgtataggctcaggctttcctgcaaggttatgaaatgctgataaaattggtcttattttgaaaggctcctcagcttatacctttccttacaaatgcttccttacaaatgctaaagcatttaatgactcctgacttaaagggaatttggacagattgaggttgttggtcttggaaatataatactgcaggcttctgtaaaatacttgaaatgtaattgttttaaaactttcaaagataccacttgtttgcctgttggttagaatactggtgaaataatttttaatcttttatgaataactaatttcatcataagaaaacttagctaagcatggtaaagctgttgttatacaactgtggaattcttcctgaggagtaactatcttataataaatgtagttgattatctaaagtagttttattcttggaatatctcataataggtttattctcttcttgtcagtatttccttgtagattgagcctgtggatttgcatttttgtaattgtgaatcaccattataggagatacatgcattttatctacttttcagtttgtatggggttaactttattagaattatctttaatgttattttgcttatatacttaattttaattatagacaaacattaagaagctggagaaaattatgttctagtgacatttatatagaagaagaatcttttttccccctttcttttttgaagggagatgaggcagtcatattttggtaaagaatttgtagactttgcagaggtctcttcaaaataatctggctcagagtcttgacatatcctcagcagacatggtgcaaattagatggcagagtggtgggtacaagttgaccataaaataacgcattaggttagtaatgcccaaataatactttgggttttcagtgttgcagagaagtcagacaactgatagttattataaagaaaaatgttctgagagtgaggtaaccgcttaagggaaggaagcctccttctgtcttattcactaatttacaagaagataattgtgttacacttccttaggagtcattcatttgtatatttgacacttttgctttatgaacatgtgaagattattcaaaagtaagctgttggtgatttttttcttccaagaaagcatgccacagggcaacttctagggttggttctcatctagtcctgtgctccacactatctgcatctgcacttaagtttcaatattagataactcacatgtttaaactatgaagaaagagttaaaacatcctgagaatgctagtaagtatgtatttttgaaaggacttccaaaatttgagtttaaagaggtaaactccttttacatgacaaagttacttagaaacactactgctgtttccctctcccttgccttctccctgtcccatgcatacccccagctgtgttccagaatgatggcacataaagtaaacattcatatttatttccctttttttgtttttttttttttttttttttgcttgtttgttttgtttttttgtttgagacagtctcactcaatcacccaggctggagtgcagtggcaacatctcagctcactgcaacctctacctcctgagttcaagcgattctcctgcctcagcctcccgagcagctgggattacaggcgcctgcccccacgcctggctaatttttgtatttttagtagagatggggtttcgccatgttggccagactggtcttgaactcttgacctcaagtgatccgcccacctcggcctcccaaagtgctgagattacaggcatgagtcactgtgcctggcctcttattttttctttggttaaacttttagggaaaaagtttgagctgcttttaattttctttttgtttttaaataaattattaaagtttctctatgttaggaactcttgtgtacatgagttcattgagcttattcttaataaagacaaatcttctagaaataatagttgtatctttaaatgatctcaaggaaaatgtttggtttctctggggaatgaattttcatgacctaatcttaaatcaggttattttttctagcctgtttactaaatttctacatgttataacctaatgaaattttcttacttcctctttatttaaaacaaactataattactgtctttttaaaaatcttccaatgtggcgttcttatttttcttaacatttgaattttcctgggccaaaccatgttactatgatacacattatttaaggctgttatataatacagtaaaattgtagaactttcataccttgaaggatcttagcaattatttaattcaaacccattctaacatagatgataaaacagatttgcagggttgggcacggtggctcatacctatattcccagcactttgggagactcaagcgggaagattgcttgagcccaggagttcaagaccagcttgggcaacatagtgagaggctgtctctacaaaaaaatatttaaaaaatagccgggcatggtgtcacgtgcctgtagttccagctgcttgggaggctgaggtgggaggattgccagagcctgggaggttgaggctgcagtgagccatgatcacaccacagcactctagcctagagcctccctgtgtggcaggctctacacttcagataggcaacagatcgagaccttgtttcacaaaacgaacagatctgcaaagatcaacctgtcctaagtcatataatctctttgtgtaataataaaaaccccatcttctaaccttaaacctggtatttttttctacgaaactatgttctgcagtccaaattatttttctttattattttgaatcctaaagtagaaatagaaacttagaaaaataaaaagcaactcctttatgacatatgaggactttttcagttttaaataagaaaaacccaactcaaagtagcttaaataaaaggagacattttttgacttacataacctaaaagctctggcctggatctaggtgctcaacagatctcaagagtatctctcttattctctctccctcccttaccctcctcctcttttctctcttctgtatatatgttattttcaaacaggctctcacaagtagtggcaagatatagttcctaatagcttcaggtttgcattctacctactttagcaactatgatgagaagagagctacaatttgagcaaaaatttgtagggtgagttctgatttccctggattgaggcacatgcctattattcctgaaccaaatattctgtccagggaatggaattctctggggcatgtatctaaagctgaagtgtagagcctgccacacagggataataatagttttccaaagaaaaatcaaggaggggaaagaatgttggaaagagaaaaaaatatcagttgtctgcttcacatttgttctcaataattagtttcatagaagtgaaatactgtgtaacaccctaaactttagagattcttcgtagacaggaaaaataagaactcaatgaagttgtgacttcattcaaatcacgtagtttatatacatgctattagtaaaacccaggacagctgagtacaagttttacccttatattcacattgaggtccagatcctggttttgaatgagataattacgtgcagtcggactgttttctgatcctaaaaatagagacaataatatctatcttgtaaagttatggtagtgttaaagatatataaaatgttggcaagtaccttaatatacaataactactgctatatgttgtcattgtaataataatcatatttcttcctttgttgaattgctttcctgtagtaatcttattgtgatcatcctgaaacatagatttccgagcttcaagcaaacactattatgttgaaaaatctacattatttctaagtttagcagtgccagtggaaagtttattgaaatagaaaattacttttttaactgaggagtgtagattgtgaattcgtgattcatcttcttaggagatgatcggaatattgataaatattgatgcatagaatatgaacaaaacattacatatcttgtgctgtgatattaaagtagtattctgttctggtagtagtatggcagtattttaggtctgaaagatgtacataatctgtactttgaagtctgttttttaagagattaatcacaagagatttacataaaacaactaaggttaaaaataaatggtggattagagatacatcaggcaaatttcaatttcaaaagcagatgacagaatctcagtatcagggtagcatttaaagcaaaaagcattaaactggatcaaaaatgtcattttacatcaacacagggtacactccaggtaaagacttaacagttatgaacgaatgtgctaaacatcaaaatgtattaagtaaaagctgaaagaaatgaagaataattggtagaaaagcaatgataggaatccttaatgtacttcaaaaggcacgaagtaagaaggtacagtcatgtaccacataatgatgtttgagtcaacacctgacctggtatacgacaatggtcctataaaattataatggagctaaaaagcttctatcacctagtgatgttgaagccgttgcaatgcaatgtatcactcacatgtttgtggtaatgctggtgtaagcaaacttactgtactgtcagttgtataaaagcatagcacagttatgttcagcacataatactttataatgataaacgaatatgttactagtttacgtgtttacagtactattattttagcatgtgcttctgcttattaaaaaatgttaactataaaataatctttaggcagatcctacaggaggtattccagataaaggcattattgtcataggagatggcagctccatggatgttattgccccttaagaccttccagtgggacaagatgtataggtggaagacagtgatattgatgatcctgaccttgtagaggccaaggctaaagtatgtatttattagtttttaacaagagtttaaaaagtaaaaaaaaaaaataaatttaaaaatagaaaaaatcttaataaggatacaaagaaaaaatgtttttgtgtagctgtgtaatatgtttttgttttaagttaaatgttacaaaagagtcagagttaaatttttttatatttataaagtgaaaaagttataaaatgctaaggttaatttactgaagaaagaaaaaatttttaaacagatttagagtagcatgtttataaaatctacagtagtttacagtaatatcctaggccttcacattaactcaccactcacccactgactcacccagagcagcttccaatcctgtaagctccattcgtggtaagtgccctatacaggtgtacaatttttatatcctttataccatttttactgaaccttttctgtcttttagatacacaaataacattgtgttacagttgcctatgatattgaatacagtaacttactgtacaagtttgtagcataggagctgtatcatatagcctgggtgtgtagtgaactataccatctaggcttgtgtaagtatattttatgacacagtgatgaaatcatccagatacagtttctcttaagcaacacataactgtatatatatatatataggtggctttaataataaaataatgaaatatatttctttttttctgtcattgacaaaacaattaccagtcttactaattagatcaactgcaaaacaaaatctcactcaaaaataaaaatatgtaagtcccattccttgattacaattcattagaactggagatttttaaaaatgtttaaatttatatggaaatataaaatcatgttttaaataatttttgattcaatgaggaaatgtaaatttagaactaaagattaataactagagatttataaaggcaaaaatgttaatgaattaggaaacagtaaaccatttgaactaatctaaatactgattgcatgaaaatgccaataaaatcaatacatatttttaaaagccagtcaaggataaaagaaaagagggaaactaaaagtgagacattaagtatgagaaaggagataaaactaaagtgtggaggtgatgttaaaaattatattcaggtctgtgctaatcattttggaaatttcagtgagaagtgggcaattttcagtgaatatatcattgtaaatgctttgaggagagacaaaatctgaatagaccctgcaataatgaaaatgtctaggagccctcaagaaatacctggtttaaattgcatttcaggtggctggttatcacaccttgaagtatcaagtaattatgttatctaaattggaccaggtgttagaaaaatatgtgagacttcacaggtggctgcttatgtagcccttataccttaatctgataaaggtagcatatatttaaaaagagagaaaaccagaaggtacaatttagggaaaattaaatacttctatttggccaaagtaagagtacattcaagggaattgtgagaggtaagagtggaaacagaggttggagctgtatttttatgctgtgattgaattacagtgtgtgataaatattgctcttatttgggtagattaccatttaacattttgaattaattggtaattggattaatcttaacttttaaaaaactaatctgagagtggtataaaggatagattacagaatggataaagggtgataaatcagttggctatggcaaaattgcaggaagaaactgaaataggccacagaaaactgaaactgacattttgagtagtatttcagaatcaagatctggattttggcaactgaatagatgcgtaggaatcaaagatgagtatactaaatgaacttaatctatgatttgtctgtcattttattgtgtaccattagtgtgtatgcatgtatgtatgtgccaggtagttaataggctgactgtgtctcttagctccactctgctgcctgggcctttgccatagtgctggagttccctcacttctcttttctgtaaccctattatattactgctgtctctcagctgtgtttcattcctcaagcagaaagaagatgggaggatcatatagtagttgactagaagctgtggagtttgagtgctgggattatatctagttccattacttatgaagattatatctagttccattacttcacctcatctataaaatggtttaccaatagtacctaccttacatggttttatgagtattaaattatgtatttctaaagacatttagaacaatacaaagaatatagtgtgggctcaataagtgacgatggtgttagttattagaaggccatcgagtgctggagaaaataattgaatatcattgatggaaataaaggaagttttccacgttaaaaagcttcggtttttggaaatgtgtgttttcagtatttctgagattaccaggtagaaattccagccagatgttggaattctgcactggcagttgggaataaagtcatgttaaaggagataagttttggagttattgtgtaaaattggtaaagcactggaatagattggtttgacagaggggaaactctttttgagataggcctatatttagggacaagagaagagacaaccaataagggttgaaagaaaccttgagagagtaagtcctatgacagaagcagggaagtttcagaatgattgcagaaagatcagccaggctcttcctgttctccatcgtggtgcaggatcaaggtgaaaaggataaccccatgcaggaattttgcatctgcaggctccgcttcaacatctgtttaggagaaagtggagacagactgacctgagtaactaaggtcttggaacagcttacaggtcagaaccaggtgttttccaaagctagatatactgttagcgcctttggcaacagaagaaatgaaaagactgttgtctgctgcacagttcgaggggccaaggcagacgaaatcctggagaatgatctaaaggtgcaggagtgtgagttaagaaaaaataacttctcagatactggaaactttggttttgggacccaggaacacattgatctgggtatcagatatgacccaagcattgatgtctacagcctggacttctatgtggtgctggaaaagccaggtttcatcattgcaggtaagaagtgcgggacaggcttcattggtgccaaatagaatcagcaaagaggaggccatgcgctggttccagcagaagtatgatgggatcatccttcctggcaaataaattctcatttctacccaaaagggtaataaaaagttttcagtgaaatgtttaaaaaaaaaataaaaaaaagatcagccagcagccaggatgggattgtgaaaacagcaggaaattagttgttgacaaagcattaatgaccattaagaaatcagcctcggctgggcatggtggctcatccctgtaatcgtaacactttgggaggccaaggcagatttcttgagtccaggagttgagaccagcctaggcaacatggcaaaaccctcgttcctccttaataaataaataaatgaataaataaacaagcaagcaagcagggcttggtgttaggcgcctgtactcctagctactcgggaggctgagggggttgaacctgggaggcaaaggttgcagtgagccaagattgcactactgcactccagcctgggtgacagagtgagaccatggcacccccctccccttcaaaaagaaatcagcctcataatcaatttctctggattaaggagtaagagcgtctcaagatttgctgtttatagagagggaggctaatagtttgagagagatacagaatctagggagagtgtgggtttttggtctttcagttgtttgccagccttggataaagaatgaagattacttgagcatattatttagagacaagtggagagaataaaggcacatgccagataggagataattaataaagcacttgtccaaaatagaaacttgttgaacaggaagagacgtcaagtataaggagattttaagatgggagaagggaattttgagtgtttgtattggatgacctcagggttcccagtaaagcaggagctgaattcatcgaaggtgatgtgttggtcaggatcaagagagaggttgggagaacaaagtgctaaaatcgttgtggtcaagagtttaaaaagtgtataccagaagagttattgagtgataggggtttgaaataggcaaagctgtaggaaagggggctggaaggaatattaggaggaacactaaatatacttctgaggtctacctcctggtctgtgaacataaaggagctgaaagagtaatggctgaagttctttagtttagctaaagttttttagctaaagctagaattgttgaaagttgtatttgaggaaaaaaagttaaggatacagttgaccgttcgataatgtagcccactgttgaccagaagccctacccacaacataaacaggcaataacacatattttgtatgtgtattatatagtatattcttaacaataaagtaaactagagaaaagaacatgtatcaagaaaatcataaggaagagaaaacacatttacagtactgtactgtatttattggtaccatacatttatgttgctgtttacaagatgaagcatctgtctgaaatggccagcagctacagctgtacctatctactgtacatatcaagcaagtcactttattcttataatgtctatgacttctttctttgaaagcgcttccatcatcactgttggcacttcatatgggtctcatggtgttaaggtttacggcattgcactagacacaatgaaaactacacaagagggccgggcacggtggctcacgcctgtaatcccagcactttgggaggccgaggcgggcggatcatgaggtcaggagattgagaccatcctggctaacacagtgaaaccctgtctctattaaaaataaaaaaattagccaggcatggtggcacgtgcctgtaatcccagctaatcgggaggctgaggcaggagaatcgctttttcccagaaggcgtaggttgcagtgagccgagatcgtgccactgcactccagcctggatgatagagggagactctgtcgcaaaaaaaaagaaaagaaaaagaaaagaaaagaaaaacacacaagagccgtgagagagatagcttttgattgcaatacacaatttactggagagatgagctgatcatacagagatgattagtgtcacacagtgttttaaacagattcttgcaaccctggagttcactgcagtagcaacagaagttagctatgagattttaacagtagtatagtatgtactacagttaatattaggtagctatgatttaatgctgcatctttgcatttgtttacatttatcttgactacaagtggtattatgtctggtcttaaggtttgtgtgcatatgttttgatgaattttaactttttataataggtttgtgtatattttatggcagtaaatgataaaacagactaatctacatatattttatgtagtcatgacataaacctaactttttcttaactttttgatatttctagtctatgtgtttcatctgcaggttttttcaaattgttgaaatctctgaaaaattttattgaaaaaaaatccatatatgtaagtggacccacacatttcaaacctgtgttcaagggtcagctgtgtaaataattttcctcaaaattaaagtggaaaaggagagttactactagtagaaagtagaactgtacccttgggcaggggtgtgtgtgtgtagttaaagatcaatttaacttaaaaggtcttggttagagaataaaaactggcccttattagctttaatttacatgaaaaatgaaaaattttaggccaggcacagtggctcaggcctgtaatcccttaactttgggagaccaaggggagtggatcacttgaggtcaggagttcaagacagcctggccaacatgctgactcacccttccctactgaaaatacaaaagttagccaggcgcagtggccatccctacagtgctagctactcgggaggctgaggcaggagaattgcttgaacccgggaggcaaggttgcggtgagctgagatcgcaccactgcactccagactgggtgacagagcgagactccatctcaaaaaaaaaaaaaaaaaaaaaagatttgaaaacagagtattttttaatctgcaagagctttacagccttttattcatatgtataagcttttaaagatgactaaaattttagtgtggactttccactcattggaaatcctatattgcaggtgttaattcaattttagtgagtgtgcatcatggctcagagagataggactagaatgaggaggtcacattggagactctgaaacagatacatgtgagcctcccaactttttaatatttgttaatctagaagtgttgaattttgggtgctgacaaggcagcaggtagataagaattgcaaagttaagaaaatagactgtaatattgatggtaaactaattgattaaattttaaaatgtacttttccatgtttttctttgaattgtcagtaattttgtttcaactggtattcatacatagattattcacccaatgttgacaactagtagatttatatattttttatgttgcctatccttttttgggtaaggattaacagaatgtataatcacctacattataggtacactactaatcacttgctacttgaaaaaacctaaagctttgaaatctttttattattgcacacaaacttatgccaaaaatggagataaagagaaaaatgtcatccactaaaccccaacaaataatgttgacaatgtggtctactcgtagactcgcattgacttaatttttttaaatcttattgcatattttgactagataataaatgcatatggttaaaaaattcacatggttcaaaaaagtacacctcccactcatcttccatgtgatatttcctttctgcttagcaattctgtatttatcttgctaaacatgaatgacagttgtttgctgaaattacattaaatgtgacgtaataaaatcattgtaagtttacattttttaactttaataatttttaatgttttaatgaagagtatgaagagtagtagtactgctcttcaaagtactactactttaccttaccttttactgttttgttaagaaaattaggccgggcgcagtggctcacgcctgtaatcccagcactttgggaggccgagacgggcggatcacgaggtcaggagatcgagaccatcctggctaacacggtgaaaccccgtctctactaaaaatacaaaaattagccgggcatggtggtgcgcgcctgtagtcccagctacacgggaggctgaggcaggagaatggcgtgaacccgggaggcagagcttgcagtgagccgagatcgcaccactgcactccagcctgggcgacagagcgaaactccgtctcaaaaaaaaaaaaaaaaaaaagaaaaaagaaaattatatagaaataaaattccagctattccaaaactgcaccttgaatacaggtacagaattgctaaaaccgtgtaccattttgtagttttagcatgcttttgtgtaactgcatctggtgtttgatcctcatgagagccctgttaaggaagggtacatattattgtcctcattttccttcgaaaacacatcagagtttgtattttgactgtcagcattcaaatacaagtcttttatttataaaattttggtctttatactgtggctaaaaatcttaaatcacttgtcatgatttgaaatggtttataccgattttttttgacatttatacacacatacacatatttttaaattgtctataataaaatcatgctcatctttgaaaaaatattaggagtactacagtggatacctacatacttgctattcagcatacctggttttttgtttgttttttgagacagtcttctctgtggtccaggttggagtgcagtggcacgatctcagctcattgcaacctccgtctcccaggctcaagtgattgtcctgcctcagcctcccaagtagctgggactgcaggtacacatcaccacgcccagctaattttttgtatttttggtagagacggggtttcaccatgttggccaggctggtctccaactcctgacctcaagtgatcagcccacctcggcctcccagagtgctgggattacaggttgtgagccactgcacctggcctgtttttaaattcacataaatatgttttatatttttcattagggagaagaaggttgtgtctacaatttttaagacattggggagatttagatgccagtagtaacttaaaagagaaataattgcaaattctttttcctcttgagtatactttcatttaaggtacagtgttctgtaagttacttttaccgttaaacttcttaatgttgcttattgtttgtcttacatttttaggttggatttttcttaagtcacatgtctaataaaaaaaacccttaaatacctcatttattcgtcttcgttagtgaatgcattgttgtacatattagatttttctctttagataactcagcttcccctattaagtgccacatgtattacaaaattttatttatgttttattgtttaataaactcttgagaactagatacattttaatcatttgtaatacttacattttctaaaacacttcatttttccctggtttcttcaacaaagagatgcatgtagtacaaggatagctttacctgtgttagaagattgtttcacacatttacatcaactgcatagtcctgtttttgttgggccctaatgccagcatcactttttgctactgctgtttctgccttaaaggcaatatgcctctgtctagtttgctgattctgatactctttcccctggaaagtaggtaatcaagtttgtgaggagctgtgtgtttaaggagtccataaatccttgtggggagccctaggtgtatagagcatagctgtagggcagaggcctttgacacttattctggatatgcagtggcctttgcctatggggttcatgggtcagagcgctgttgtgacctttgaataaatgggttgttatgataattgttttaagggaggagagttattctgatatcctttgtattgatattgctcttatttattattgagctggatttaagtattaatcatttaaggtcaaatttctaatgtatatatgttcttaaatggctacgacccagttaccatagcaatttagtgaaataactataatggaacattttttttcaatttggcttctcttttttttctgtccaccagggagtaactattcccagtcagaggcgctatgtgtattattatagctacctgttaaagaatcatctggattatagaccagtggcactgttgtttcacaagatgatgtttgaaactattccaatgttcagtggcggaacttgcagtaagtgcttgaaattctcatccttccatgtattggaacagttttcttaaccatatctagaagtttacataaaaatttagaaagaaatttaccacatttgaaatttatgcaggagactatatttctgaagcatttgaacaaattaattagctttgttgttcaactcattgggctaaagaagccaaaagcaatgggttttaatgtagtcgaagccaaattatatttatgaaagaaatattctgtgttataaccaccaaatacagcccaattctgactagatgatggaagaacctgtcccatcagaggtccagcatgaggtccagcagaggtccaccagaggagttcagcaatttgctgctcttagggcagggatcaattccttaatatcttaggaagactaggtattgacagtaatggtgacaaagcaatgaaaaggaaaggaagaagtgataagacgtggcagcaagctgaagtatgatgagtaaagaataggaatcaaagtatgtggagtgttagagaaaacctggatttagatccagattctagtcctatctctgtcattaatctattgcgtaaccctgagcatatcatctacctctctttgagtttgcttgtcaataaaatgaagagactttgaaatctgagacttcctggataagtactaaatacagattatgtcactgatgtctgcctctatttatttctcccttttaccctaatctctataagtctacctcagtcatcctgatcctattctacttctctgatgttgttgtcagataggtgtgatcatcctcatcagatcttttctgtattcttagagacagataactttatcaaagaccacagatttattagtatagcatgttaaagtcttctaaagagtctcattgatgctcttttcatctcagtacaatttttaaaactgctgaatgcaaggtactgagctgttggaagtgactgacagatgaatgtaacagattcatagagaaggaaaaaggaagaaaaactcatgctcttcctatagtattgatatcagtgtaagagccaagagaaaggtataaagtatcatgcagatattaagggaaagaaaacattcactttagtaatctttcctcattttctagtttcctcttatgtactatgatttaatactgtagtaaagttttaataaaatatgagctatatgtaattaagtgggaggttgtggggctaggcacgaggctcacacgtgtaaccccagcactttgggaggctgaggcaggcggatcgcttgatctcaggagttcgagaccagcctggacaacaaggtgaaaccccatctctactaaaaacacaaaaattagctgggcatagtggcacacacctgtagtcccagcttcttgggaggctgaggcaggagaatcgcttgaatccaggaggcagaggttgcagttagccgagatcatgccactgcactgcagcctggacatcggagcaagactttgtcttagaaataaataaataaatataaaataaaataaatgggaagttgtgtatataaattataaatgctacattcagaaaagcttttgaaggttgtcagacagtttcttaaaggaagttcaccagttctttattgaacattgaagaaaacatacagtttagactggcattaaaactgaaagaagtggccagacgcagtggtagacgcagtggttcacgcctgtaatcccagcactttgggaggtcaaggtggatggatcacctgaggtcaggagtttgagatcaggctggccgacatggtgaaaccctgtctctactaaaaatacaaaaattagccaggcatggtgatgcgtgcctgtagtcccagctacttgggaggctgaggcaggagaattgcttgaagccgaaggtggaggttgcagtgagccgagattgcgtcattgcactccagccagggcggtaagagtgaggctccgtcttaaaaaaaaaataagtaaataaattaaaaactactgaaagaagtattacaggcaatgggaaatagcttgagtggaagtgcagcagaaggaaaaagctggacaagaatgtagtgtcagagaataggtatggaacgtgtgagtgactgttagaggatcttgaatggggataacagacttgatttcataaatactgagatgtcatgataatacttgaggactaaaccatgttttaaggacagttgtatgcaaagttgtaatcgcaagaggaaaaaatagtggaaaagaaaccagtaataaaacttgccttaatgcaggtatgctaagacaatcaaatgggatttcattaattttttatttgccatttatagccaaagattttgtaaaagttttgagcccagtcaggtgaaatagtctcagaaagaaagaaaagtgaatctgagacttggagacattaatgttgatattttggttttaaacgtgttttaaatccggtaaaagtgagcttctcacatgacaatattcagtgggtacttgggagtatgggttcgaatctaggtaggagatatatcgatattttgggcatcatcaggaaagggagagtagttaagcctttcatataaataatggtgtggcgtttgggcatgggaagtcttggaggaaaggaagaaaaggagagggtgaggactgagataagaatggcaacttgggtttaggaagaagaagaggaatcaatgtagagaacagatagtgctgaaaaatacagcatcttctgtagggattggcagctttttcttgatttttgtcttaatatttctaagagatggaaaaagctactatattctagacatttaacagggttaaaaatgttactaaaagatgatcaatgtggttttcattcaagactataacaatatgtatatatccaaggaaatttaattctgacttaaaaaaattgttttgcttgtatagatttagggacacaagtgtaattttgttacatgcatagagtgtatagtttcaagtcagggcttttaggttgtccatcatctgaataatatacattgtacccattaagtaatttctcatcttctactcaccgtttcaagtctccactatttatcattccattctttacattctgattttcatttactaggtgtattagtctgtttttgcattgctttaaagaaatacctgagactgagtattaaacaggtttaacctgttttctttatgaattcttctttaattggctcatggttctgcacgctgtacagaaagcatagcagcatctgcttctggggaggcctcaggaagcctccaatcatggctgaaggcaaaaggggagcatggtgagaatgggagcaagaaagagaaggagtggtggggagaaggtgccacccacttttaaatgccagctcacttaccaccaagaggatggcccaagccattcatgtgggatctgcccccatgattcaagcttcttccaccaggccccacctctagcactggggattacaattcaacctgagatttgggagggaaagatatccaaactatatcactaggtctggatcttgttatttattttttggaacatagtcatatatatccaaggatatatattgtagaagtccacagaaccatactaatattggacttctgcttagttaggtcttatctatctgaaacatgatattcatattgcagagaagattattttctttagtgattgaggaaatctttactacttatacatttttaatataatactataatatttgaagatgcacattttagatgtagtttaattgaaacctggaaatactattaatttgctttttaaagtcctaaaatcaggattatcagattctgaattaatggagtttaaatcaaaaagattacaaggcagtttttcagttttattctggttaattttatcacagctttggaatcctactttgtttatttgcttcttgaagttagatttcccagtgaaatttcagtatcacataaagtcttatgaaatggctcattgcactttgaactttgagtcaaggaagtgaaatttattgatagattgttggtgtaatatttatcctgtttgtggtagcttttttgaataataagtgtcttagaagaccatgttggagtagcctgcatgcttttatcaaacatattaattatgtgatggctgatactgctttagatattacatagaaatagtagtaggtgtttactaaactggaaatttcatttaacttggtttagctttgccttgttctcagtcacattgataaaaatgtaagacttttgtttatcttttagaataatgacaccttttggtgctgagaattttttgttttatatatatatatatatatacgtaatataaatacaaaatatatttaaatatgtataatatttctcatacactttatgtaactttgtgttcctgtttctctattatcttggcatgttttcttcaaatggcacttcttaacctcctaaggttaataaatttctttgtaatggacttttgttttctaattcctcagcgtatgacaaatgaattatactttgtcaaattatttaggtaactttcagtttttgaagtcctgggatcataacattcatcagtctttaatttctgtcattaaggtcattagctataaatgaatttatgagtagatttaaaaaataaaacatacaatccttcccttaacacactttcccaccatttggttcaactgctagtgtaaaagcatgatgaattttgagaagttatattttaccagttactttattttttaccagttatttaaaacagacatgagccaaagccagaatacttgttaatgaaaatgaggtgttttggaggaaaggaaggttgtgctgcagtttttacttgaaatctgttacatttctttacagaaatttcaaatctcttgtttcctgttatgatggtggcattatatacctttaaaatgtgagctataggaaaatgaatgatggttaattttttaataaatatttagacttgtgtttttgaaattttttataacattgttataggttttatcctctttctcttgtgaacatgtagtgatttgtattttgtgatctttgccgcatgctagagacttaagaatactatagcaaatatctgtcttctttacatttaaaaatttttcgtgactactccctgttgatatctgtcttaaaagttacttttgatgtagttcacaaatgtaccagataattatttcatcgtttttaatgcttaaagtttttatttgtattaggatttttagtatgattttaatgttaaagttttgaagttactctgccactagaagtctaattttgggacttactattcatgaaataggaattgacttttatataagtaataggaccttattttgaaggttcaaactggagaaaatcttacattgtttatatttttatttcatttatttcagttgatttgcttgagatcaagattgcagatacagaatccatatttcgtgtatattgctgatattaatcattaaaatcgtttttgacagtttgacagttaaaggcatttcctgtgaaataatactggtatgtatttaaccatgcagatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggtttgtactttactttcattgggagaaatatccaaaataaggacagattaaaagctatattttattttatgacatgtaaggaactataatttgttttctattagatctgcaggtgttttgcttactctggcattggtgagacattataagggtaaataatcctgtttgaaggaaaaggccttatggcattgtaacatgagaggaatttttcttaacaaggatggttaactgagaagaaattagcatgggaccaatattttaaaaattttggtctataggtagaaatgagatctgttctgtggtcttatgtagtgacacaaaccactttttctccattttggcttatgtttctttttctttccttttttttttttttcctttttgttagagacagggtcttgttctattgcccaggctgagtagctaagactacaagcatgtgccaccacacccagctaattttttttatttttatttttgtagggacagggtctcactatgttgcccaggctggtctcaaactcctgggcacaagcagtcctcacgctttggcatcccaaagagttggaattacaggtgtgcgccatcatgcctggccttaacgtttcttaagacttgattattttctatttagcttctgtggatttactgattaattttttaactaggagagaaatcagtatgaagaggaagtaataaagaatgaaaacatggtatttaaatgtgcaggtttagaaagttaatgaagtttgaatttgattgatctgtatttagagaaggcaacgtcttattattttaaaaccaactatccgccctgtgcggtggctcacgcctgtaattccagcactttgggaggctgaggtgggcagatcagctgaggtcaggagttcgagaccagcctggccaacatggttaaaccccatctctactaaaaatacaaaaaaattagccgggtgtggtggcaggcgcctgttttcccagctactcaggaggcttgaggcaggataattgctgaacccgagaggcggaggttgcagtaagccaagaatgcaccattgtactccagcctgggcaacaagagtgaaactccatctcaaaaaaaaagaaaaaaaaaacaacaactatcttcatttaaaatattaaatgtgaatatttaaagtgagactaaggtgcaacatttttagatagtaatgaagaaaaggactaactttgtagtgttgctgccttgttaaacatactagatagcatattgccaatctttaaacattctcaatgataggatttatttactttttctgatttttagcttttcttttgaaagaaaataagaggaagtttcatttactgcaaaattttaaatgctgctttgatgtatcagtagagatataattttcctttatccagaatccaagtagctggaaaaaaaaatcaaaatatgctgaacttttttttttttagccagaaacccatttcctatcgtctgtacaaataaaagttaaatatatctcaataacttagaaaaattattttttgataatccaggaagtattagcaactgttttaaaattaagataactagtaagttttatttagctttcaaaaataggcatctacatcatcatctctgcatacctttaggaatttcctaattcttatttcccttcatctgtactttaacacatgcaaaattgaaggttagattaaatatttatgatttatttgtttatccttgactacataaatttccattttattgattttccctgccttatttaagaatatgctatgattaaaacacaaaaaattttagtataacccatatatatatagaattcacctttttgttatttaaatattattggcttattttcttctaagtaaaatacaattactggctaaaataattgaaataagcaaaaaaaaaattttaaagaccttgtatacaagattactttgccaggtactgttaaaagatgcaatgacatttaagacgtaacatccttaaggatcttattttctgggggataaaaaactttaagataaattagaataaaagatttaaatggcattttaaggtaccaggtaccagataagatgtcacaaggctgtatatcattaattgccaaatgatttatacaggccagatttctttgttggtcaatagaggtttaaagtgatgaacttctgttgtgtttttttattaagaaggtattatcttattagtaagaagtgattttttttaagaacaagcattttataacatcaaaagaaatcagtagtactctttcctaccccctcatatttattctgaaagtattcaagcattatattgtcatgtaagaaactggagcttctcatgtttgtattgctgtagaagtaaacatgtatttgccatgcgtcatcagggaagttgcactcaccgtccaagaacttttgttaaagtaaatcttggaataggtagctcatttgaaatgtagaaaaaattaaatccatatctgaattttgtttatatgtatgtacacgtaaactaaaaacgtatttaaagctagtattagatgagaaaagaggtttttttacttaaaattttaaggcaaaagtagtttatcttagatcttgtgagattgtatttttggtttaaaatttgagaatttgagtgaagaaaaatcatgtgaatgaaaatgcaacagataactcagattgccttataatagtctttgtgtttacctttattcagaatatcaaatgatagtttattttgttgactttttgcaaatgtttaacataggtgacagattttcttttttaaaaaaataaaacatcattaattaaatatgtcatttcatttctttttcttttctttttttttttttttaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtcagttaaattaaacattttgtgggggttgttgacttgtatgtatgtgatgtgtgtttaattctaggagtacagctgatgaagaacttgcttgacaagtttttaacttatgtattatttcgaagcagtgtttacgtagcagtaacatgaaagtttctaataaaatacccaatgtacacagcgtcaaaaaagctgcatttttccttttcctaattcttcgttgtttgctgaaatctggggcaaaggtgcgggagggggctaaatgactgggatatgaagtaggaatgggagaggaaagaaatagatgggaactcagtcatttgggaatgattcatatggaatgtttttactgcttccactcctgtctgccttccaatttattctcaatccctcagagtgatcttaaaaatagacttgattgtgtcacttctgtttacactttataaggaccttgtgtttttttttttaccatgacctacaaggcccagcataatttagcacagggctacctcctacatcagcactagtcaccttctctccttgtttcttgagattcagtcatactggtctttcttcagttcttcaaaatgctaagcttctgcctcttctagtctttccagttattttccttctccctgtaccttttcatctcagccttttcccctgaccttccatagctatcttcatatttccagccttagcttcaatctcatattctctgaagtcctttgattgtcctcccgttattctttttttaaaaatcctatttccttatattgtatcttagaattatttggtttgtttcatttttgcctatgtgtgatatatgtatttctacataggtatatatatctacttatagacaagaattcttcagattaaaaaaatctgatttgtaaacattcccaagtggttgtttaccatttttttcttcccccttcctatttcttattctacctgattttcccctgttcattcaccacactcgtttctttctcttttttactctctcttaatttttcattcaatttttataacatgtaataaatctaactgtagcgtctgagtattaagaatattgctagtaatacttcacctgtaatcccagcactttgggaggctaaggcaggcggatcacttgaggcccaggagtttaagaccagccggccaatatggcgaaaccctatctgcactacaaatacaaaaattagctgggcatggtgtcgcacacctgtaatcccagctacttgggaggctgaggcacaagaattgcttgagcctgtgagatggaggttgcagtgagccgagatcacaccagtgcacgtgcacttcagcctgggcaacagagcaagactctgtcttaaaaaaaaaaaaaaaaaaaaaatatatacacacacacacacacacacacacacacacacacactattactaccaatatacatacatatatgtatgtatgtatgtatgtatattggtagtaatagtaatacttgggcccctgcacgttttaagtgaaaatagatctaatattaaatgtctttagcccttaaattttttttaagtgttcagaagtttccctttaaaaaaatttttaatatataataattgtacatatttatgggatacagagtgatattttcatgtatgcagtgtgtgatgatcaaatcaggataattagcatatggatcacctcaaacatttgtcatttctttgtgttaggaacattcaaaattctgtcttctagctatttgaaaatatacagtaaattattgttgactagttacagttctatagaacactataatttattcctcctgtgtgtaattttttatcttttaaccaacatctccctatcctcccctcccactccctttcccggcctctaataaccacactcttatgagctcaacttttttagcttccatatatgagtgagaacatacggtatttatctttctgtacctgacttattttacttaacatcatgtcctccgggctagacattctctttagaatccacaggtttcctttcttttctctaaatctgcattttgctcagccattaacttttaaaatgtctttttccctttagttttattgttttctattttaatattgcaagatgttttatatttgtgattacaaataaaaactccattattagtaaacaaatacaatgtcatatagtagtaagtgctataaaaaatagacaggatagaaagtaatcttggtttgtatgttttttgttttttagcaaagatgattagagaaggcccaaccaagcagataacatttaagcagaggcctaaatcatataagtgagttatacaaatatctgggaaaagagttaagagtacagatgcaaaagcccttagacaagagaatgagcttggtatatctgaagagtggataagtcattttgactgaaacagagtggacaagaaaaccagtccaagtgtaaagacactagtgtgtgttcagcataggaaggatgtaatctgaattttgtgtttaatattccctgtgttcatgctttcaaaatacagatgagtgaggaaagtagggagaaggggtaataaaggaagctgagagatcagttaagaggtacttgaatagtttagtaaagatgagagaagatgtttgcttcttgttgcccctcactgcttagaatagtggcagtgaagggtaacaagaagctgtcagattaacttaaagagtttactgatgcagtggatgttggttgtaagagaagaattgataatgactcttggataataggggagggaggggctgtcaatataatataatgaagaagggatttgaagtcatttctgatttaaatctcacatccactacctacttttaatagatatgtagcctttaacaagttccctaacctttctgggccttagctacctccccttggaaatggaaatacctaacatgtaaggttgttttgacagttattttcactaggcatgtaaaggcacttgactctctgttatagaccactgtattatgttaatgtccctctccttcctccctttaggtaaagtttttagggctaataaatcccaaatatcaatgttgatcagtagtttgtgtttgtgtagtgttgtttatatcaaaaactacattgaagccgggcacagtggttcacgcctaaaatcgcaacactttgggaggccaaggtgggcctcccaccttgaactaaggagtttgagaccagcctgggcaacatggtgaaatcccatctctacaaaaaatataaaagctagctgggtgtggtggcatgcacctgtagtcctagctacttgggaggctgaggttgatcctgggagtttgagcctgcagtgagctgtgaagatgccactgcactctagtctgggtgacagagcaagaccctgtctcaaaaacacacacacacacacacacacacacaaagaaatacattgatttttcacataggtagtaagagaaacattctttttgaactcagctgtttgtgaattgaattttgtaattcaaatgctatattatgtaaactattgatgactttcaatctgcatttattttgtataattatttagttaatatttgccacttatattccttaaaaaataaaattgaggttgggcgtggtggctcacacttgtaatcccagcactttgggaggctgaggcaggcagattgcctgagctcaggagtttgagatcagcctgggcaacatcatgaaccccatttctactaaaatacaaaaaattatctgggcatggtggtgtacacctgtagccctagctgtttgggaggctaaggcacgagaattgcttgaacccgggaggcagaggttgcagtgagccaagatcatgccactgcactccagcttggcaacagagcaagactcttgtctccagaaataaaaataaataaattgtattaacatcctgatagtttatctgtttagtacctagcaagaaagaaaatgttgaacatcttaagaagagggtcatttaaaaggcctcttaaagatcatgtttgttacagtgcttaaaaattaatatgttcatctgcaaaatggaataaaaaatctgttaaaaatatatttcactaaatagtttaagatgagtcatatttgtgggttttcattttaaattttctttctctaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttc

SEQ ID NO: 16 - DNA, 16 bp, Artificial Sequence
  Synthetic Oligonucleotide
ccggaggtgcttgaat

SEQ ID NO: 17 - DNA, 14 bp, Artificial Sequence
  Synthetic Oligonucleotide
cggaggtgcttgaa

SEQ ID NO: 18 - DNA, 16 bp, Artificial Sequence
  Synthetic Oligonucleotide
gaagccatacacctct

SEQ ID NO: 19 - DNA, 14 bp, Artificial Sequence
  Synthetic Oligonucleotide
aagccatacacctc

SEQ ID NO: 20 - DNA, 16 bp, Artificial Sequence
  Synthetic Oligonucleotide
gttgaagccatacacc

SEQ ID NO: 21 - DNA, 14 bp, Artificial Sequence
  Synthetic Oligonucleotide
ttgaagccatacac

SEQ ID NO: 22 - DNA, 16 bp, Artificial Sequence
  Synthetic Oligonucleotide
cctcagggttgaagcc

SEQ ID NO: 23 - DNA, 14 bp, Artificial Sequence
  Synthetic Oligonucleotide
ctcagggttgaagc

SEQ ID NO: 24 - DNA, 16 bp, Artificial Sequence
  Synthetic Oligonucleotide
tttgccctcagggttg

SEQ ID NO: 25 - DNA, 14 bp, Artificial Sequence
  Synthetic Oligonucleotide
ttgccctcagggtt

SEQ ID NO: 26 - DNA, 16 bp, Artificial Sequence
  Synthetic Oligonucleotide
agttcttggttttctt

SEQ ID NO: 27 - DNA, 14 bp, Artificial Sequence
  Synthetic Oligonucleotide
gttcttggttttct

SEQ ID NO: 28 - DNA, 16 bp, Artificial Sequence
  Synthetic Oligonucleotide
cctcttgatgttcagg

SEQ ID NO: 29 - DNA, 14 bp, Artificial Sequence
  Synthetic Oligonucleotide
ctcttgatgttcag

SEQ ID NO: 30 - DNA, 16 bp, Artificial Sequence
  Synthetic Oligonucleotide
atgcccctcttgatgt

SEQ ID NO: 31 - DNA, 14 bp, Artificial Sequence
  Synthetic Oligonucleotide
tgcccctcttgatg

SEQ ID NO: 32 - DNA, 14 bp, Artificial Sequence
  Synthetic Oligonucleotide
tgccacattgccct

SEQ ID NO: 33 - DNA, 14 bp, Artificial Sequence
  Synthetic Oligonucleotide
ttgccacattgccc

SEQ ID NO: 34 - DNA, 14 bp, Artificial Sequence
  Synthetic Oligonucleotide
gttgccacattgcc

SEQ ID NO: 35 - DNA, 14 bp, Artificial Sequence
  Synthetic Oligonucleotide
tgttgccacattgc

SEQ ID NO: 36 - DNA, 14 bp, Artificial Sequence
  Synthetic Oligonucleotide
ctgttgccacattg

SEQ ID NO: 37 - DNA, 14 bp, Artificial Sequence
  Synthetic Oligonucleotide
tctgttgccacatt

SEQ ID NO: 38 - DNA, 14 bp, Artificial Sequence
  Synthetic Oligonucleotide
ttctgttgccacat

SEQ ID NO: 39 - DNA, 14 bp, Artificial Sequence
  Synthetic Oligonucleotide
tttctgttgccaca

SEQ ID NO: 40 - DNA, 14 bp, Artificial Sequence
  Synthetic Oligonucleotide
atttctgttgccac

SEQ ID NO: 41 - DNA, 16 bp, Artificial Sequence
  Synthetic Oligonucleotide
gtaggagaaaggcagg

SEQ ID NO: 42 - DNA, 14 bp, Artificial Sequence
  Synthetic Oligonucleotide
taggagaaaggcag

SEQ ID NO: 43 - DNA, 16 bp, Artificial Sequence
  Synthetic Oligonucleotide
ggcttgtaaagtgatg

SEQ ID NO: 44 - DNA, 14 bp, Artificial Sequence
  Synthetic Oligonucleotide
gcttgtaaagtgat

SEQ ID NO: 45 - DNA, 16 bp, Artificial Sequence
  Synthetic Oligonucleotide
ccactggaggatgtga

SEQ ID NO: 46 - DNA, 14 bp, Artificial Sequence
  Synthetic Oligonucleotide
cactggaggatgtg

SEQ ID NO: 47 - DNA, 16 bp, Artificial Sequence
  Synthetic Oligonucleotide
tttcagcatgctttct

SEQ ID NO: 48 - DNA, 14 bp, Artificial Sequence
  Synthetic Oligonucleotide
ttcagcatgctttc

SEQ ID NO: 49 - DNA, 16 bp, Artificial Sequence
  Synthetic Oligonucleotide
catatttgtcacaaac

SEQ ID NO: 50 - DNA, 14 bp, Artificial Sequence
  Synthetic Oligonucleotide
atatttgtcacaaa

SEQ ID NO: 51 - DNA, 16 bp, Artificial Sequence
  Synthetic Oligonucleotide
atgcccatatttgtca

SEQ ID NO: 52 - DNA, 14 bp, Artificial Sequence
  Synthetic Oligonucleotide
tgcccatatttgtc

SEQ ID NO: 53 - DNA, 16 bp, Artificial Sequence
  Synthetic Oligonucleotide
ttttggtggtagagac

SEQ ID NO: 54 - DNA, 14 bp, Artificial Sequence
  Synthetic Oligonucleotide
tttggtggtagaga

SEQ ID NO: 55 - DNA, 14 bp, Artificial Sequence
  Synthetic Oligonucleotide
tctgcttcgcacct

SEQ ID NO: 56 - DNA, 14 bp, Artificial Sequence
  Synthetic Oligonucleotide
gtctgcttcgcacc

SEQ ID NO: 57 - DNA, 14 bp, Artificial Sequence
  Synthetic Oligonucleotide
agtctgcttcgcac

SEQ ID NO: 58 - DNA, 14 bp, Artificial Sequence
  Synthetic Oligonucleotide
cagtctgcttcgca

SEQ ID NO: 59 - DNA, 14 bp, Artificial Sequence
  Synthetic Oligonucleotide
tcagtctgcttcgc

SEQ ID NO: 60 - DNA, 14 bp, Artificial Sequence
  Synthetic Oligonucleotide
ctcagtctgcttcg

SEQ ID NO: 61 - DNA, 14 bp, Artificial Sequence
  Synthetic Oligonucleotide
cctcagtctgcttc

SEQ ID NO: 62 - DNA, 14 bp, Artificial Sequence
  Synthetic Oligonucleotide
gcctcagtctgctt

SEQ ID NO: 63 - DNA, 14 bp, Artificial Sequence
  Synthetic Oligonucleotide
agcctcagtctgct

SEQ ID NO: 64 - DNA, 16 bp, Artificial Sequence
  Synthetic Oligonucleotide
aactctgaggattgtt

SEQ ID NO: 65 - DNA, 14 bp, Artificial Sequence
  Synthetic Oligonucleotide
actctgaggattgt

SEQ ID NO: 66 - DNA, 16 bp, Artificial Sequence
  Synthetic Oligonucleotide
tcattaactctgagga

SEQ ID NO: 67 - DNA, 14 bp, Artificial Sequence
  Synthetic Oligonucleotide
cattaactctgagg

SEQ ID NO: 68 - DNA, 16 bp, Artificial Sequence
  Synthetic Oligonucleotide
attcatcattaactct

SEQ ID NO: 69 - DNA, 14 bp, Artificial Sequence
  Synthetic Oligonucleotide
ttcatcattaactc

SEQ ID NO: 70 - DNA, 16 bp, Artificial Sequence
  Synthetic Oligonucleotide
ttgttctgaatgtcca

SEQ ID NO: 71-72 - skipped (2 entries)

SEQ ID NO: 73 - DNA, 14 bp, Artificial Sequence
  Synthetic Oligonucleotide
tgttctgaatgtcc

SEQ ID NO: 74 - DNA, 16 bp, Artificial Sequence
  Synthetic Oligonucleotide
cagatgagtccatttg

SEQ ID NO: 75 - DNA, 14 bp, Artificial Sequence
  Synthetic Oligonucleotide
agatgagtccattt

SEQ ID NO: 76 - DNA, 16 bp, Artificial Sequence
  Synthetic Oligonucleotide
atccacagggaaattg

SEQ ID NO: 77 - DNA, 14 bp, Artificial Sequence
  Synthetic Oligonucleotide
tccacagggaaatt

SEQ ID NO: 78 - DNA, 16 bp, Artificial Sequence
  Synthetic Oligonucleotide
cagttgtacaagttgc

SEQ ID NO: 79 - DNA, 14 bp, Artificial Sequence
  Synthetic Oligonucleotide
agttgtacaagttg

SEQ ID NO: 80 - DNA, 16 bp, Artificial Sequence
  Synthetic Oligonucleotide
cacagagtcagccttc

SEQ ID NO: 81 - DNA, 14 bp, Artificial Sequence
  Synthetic Oligonucleotide
acagagtcagcctt

SEQ ID NO: 82 - DNA, 16 bp, Artificial Sequence
  Synthetic Oligonucleotide
ggtcaaccacagagtc

SEQ ID NO: 83 - DNA, 14 bp, Artificial Sequence
  Synthetic Oligonucleotide
gtcaaccacagagt

SEQ ID NO: 84 - DNA, 14 bp, Artificial Sequence
  Synthetic Oligonucleotide
cagccacatgcagc

SEQ ID NO: 85 - DNA, 14 bp, Artificial Sequence
  Synthetic Oligonucleotide
ccagccacatgcag

SEQ ID NO: 86 - DNA, 14 bp, Artificial Sequence
  Synthetic Oligonucleotide
accagccacatgca

SEQ ID NO: 87 - DNA, 14 bp, Artificial Sequence
  Synthetic Oligonucleotide
taccagccacatgc

SEQ ID NO: 88 - DNA, 14 bp, Artificial Sequence
  Synthetic Oligonucleotide
ttaccagccacatg

SEQ ID NO: 89 - DNA, 14 bp, Artificial Sequence
  Synthetic Oligonucleotide
gttaccagccacat

SEQ ID NO: 90 - DNA, 14 bp, Artificial Sequence
  Synthetic Oligonucleotide
ggttaccagccaca

SEQ ID NO: 91 - DNA, 14 bp, Artificial Sequence
  Synthetic Oligonucleotide
aggttaccagccac

SEQ ID NO: 92 - DNA, 14 bp, Artificial Sequence
  Synthetic Oligonucleotide
taggttaccagcca

SEQ ID NO: 93 - DNA, 16 bp, Artificial Sequence
  Synthetic Oligonucleotide
aggttctgctttcaac

SEQ ID NO: 94 - DNA, 14 bp, Artificial Sequence
  Synthetic Oligonucleotide
ggttctgctttcaa

SEQ ID NO: 95 - DNA, 16 bp, Artificial Sequence
  Synthetic Oligonucleotide
tactgatcaaattgta

SEQ ID NO: 96 - DNA, 14 bp, Artificial Sequence
  Synthetic Oligonucleotide
actgatcaaattgt

SEQ ID NO: 97 - DNA, 16 bp, Artificial Sequence
  Synthetic Oligonucleotide
tttttcttgtatctgg

SEQ ID NO: 98 - DNA, 14 bp, Artificial Sequence
  Synthetic Oligonucleotide
ttttcttgtatctg

SEQ ID NO: 99 - DNA, 16 bp, Artificial Sequence
  Synthetic Oligonucleotide
atccattaaaacctgg

SEQ ID NO: 100 - DNA, 14 bp, Artificial Sequence
  Synthetic Oligonucleotide
tccattaaaacctg

SEQ ID NO: 101 - DNA, 16 bp, Artificial Sequence
  Synthetic Oligonucleotide
atattgctctgcaaag

SEQ ID NO: 102 - DNA, 14 bp, Artificial Sequence
  Synthetic Oligonucleotide
tattgctctgcaaa

SEQ ID NO: 103 - skipped

SEQ ID NO: 104 - DNA, 14 bp, Artificial Sequence
  Synthetic Oligonucleotide
atattgctctgcaa

SEQ ID NO: 105 - DNA, 14 bp, Artificial Sequence
  Synthetic Oligonucleotide
aatattgctctgca

SEQ ID NO: 106 - DNA, 14 bp, Artificial Sequence
  Synthetic Oligonucleotide
gaatattgctctgc

SEQ ID NO: 107 - DNA, 14 bp, Artificial Sequence
  Synthetic Oligonucleotide
agaatattgctctg

SEQ ID NO: 108 - DNA, 14 bp, Artificial Sequence
  Synthetic Oligonucleotide
tagaatattgctct

SEQ ID NO: 109 - DNA, 14 bp, Artificial Sequence
  Synthetic Oligonucleotide
atagaatattgctc

SEQ ID NO: 110 - DNA, 14 bp, Artificial Sequence
  Synthetic Oligonucleotide
gatagaatattgct

SEQ ID NO: 111 - DNA, 14 bp, Artificial Sequence
  Synthetic Oligonucleotide
ggatagaatattgc

SEQ ID NO: 112 - DNA, 16 bp, Artificial Sequence
  Synthetic Oligonucleotide
atggaatcctcaaatc

SEQ ID NO: 113 - DNA, 14 bp, Artificial Sequence
  Synthetic Oligonucleotide
tggaatcctcaaat

SEQ ID NO: 114 - DNA, 16 bp, Artificial Sequence
  Synthetic Oligonucleotide
gaattctggtatgtga

SEQ ID NO: 115 - DNA, 14 bp, Artificial Sequence
  Synthetic Oligonucleotide
aattctggtatgtg

SEQ ID NO: 116 - DNA, 16 bp, Artificial Sequence
  Synthetic Oligonucleotide
agctggaattctggta

SEQ ID NO: 117 - DNA, 14 bp, Artificial Sequence
  Synthetic Oligonucleotide
gctggaattctggt

SEQ ID NO: 118 - DNA, 16 bp, Artificial Sequence
  Synthetic Oligonucleotide
tgaaaatcaaaattga

SEQ ID NO: 119 - DNA, 14 bp, Artificial Sequence
  Synthetic Oligonucleotide
gaaaatcaaaattg

SEQ ID NO: 120 - DNA, 16 bp, Artificial Sequence
  Synthetic Oligonucleotide
aaacagtgcatagtta

SEQ ID NO: 121 - DNA, 14 bp, Artificial Sequence
  Synthetic Oligonucleotide
aacagtgcatagtt

SEQ ID NO: 122 - DNA, 16 bp, Artificial Sequence
  Synthetic Oligonucleotide
ttcaggaattgttaaa

SEQ ID NO: 123 - DNA, 14 bp, Artificial Sequence
  Synthetic Oligonucleotide
tcaggaattgttaa

SEQ ID NO: 124 - DNA, 16 bp, Artificial Sequence
  Synthetic Oligonucleotide
ttttgtttcattatag

SEQ ID NO: 125 - DNA, 14 bp, Artificial Sequence
  Synthetic Oligonucleotide
tttgtttcattata

SEQ ID NO: 126 - DNA, 16 bp, Artificial Sequence
  Synthetic Oligonucleotide
gatgacacttgattta

SEQ ID NO: 127 - DNA, 14 bp, Artificial Sequence
  Synthetic Oligonucleotide
atgacacttgattt

SEQ ID NO: 128 - DNA, 16 bp, Artificial Sequence
  Synthetic Oligonucleotide
gtgtgatgacacttga

SEQ ID NO: 129 - DNA, 14 bp, Artificial Sequence
  Synthetic Oligonucleotide
tgtgatgacacttg

SEQ ID NO: 130 - DNA, 16 bp, Artificial Sequence
  Synthetic Oligonucleotide
tattcagtgtgatgac

SEQ ID NO: 131 - DNA, 14 bp, Artificial Sequence
  Synthetic Oligonucleotide
attcagtgtgatga

SEQ ID NO: 132 - DNA, 16 bp, Artificial Sequence
  Synthetic Oligonucleotide
attggtattcagtgtg

SEQ ID NO: 133 - DNA, 14 bp, Artificial Sequence
  Synthetic Oligonucleotide
ttggtattcagtgt

SEQ ID NO: 134 - DNA, 14 bp, Artificial Sequence
  Synthetic Oligonucleotide
cctctagctgtaag

SEQ ID NO: 135 - DNA, 14 bp, Artificial Sequence
  Synthetic Oligonucleotide
ccctctagctgtaa

SEQ ID NO: 136 - DNA, 14 bp, Artificial Sequence
  Synthetic Oligonucleotide
gccctctagctgta

SEQ ID NO: 137 - DNA, 14 bp, Artificial Sequence
  Synthetic Oligonucleotide
ggccctctagctgt

SEQ ID NO: 138 - DNA, 14 bp, Artificial Sequence
  Synthetic Oligonucleotide
aggccctctagctg

SEQ ID NO: 139 - DNA, 14 bp, Artificial Sequence
  Synthetic Oligonucleotide
gaggccctctagct

SEQ ID NO: 140 - DNA, 14 bp, Artificial Sequence
  Synthetic Oligonucleotide
agaggccctctagc

SEQ ID NO: 141 - DNA, 14 bp, Artificial Sequence
  Synthetic Oligonucleotide
aagaggccctctag

SEQ ID NO: 142 - DNA, 14 bp, Artificial Sequence
  Synthetic Oligonucleotide
aaagaggccctcta

SEQ ID NO: 143 - DNA, 16 bp, Artificial Sequence
  Synthetic Oligonucleotide
gaatggacaggtcaat

SEQ ID NO: 144 - DNA, 14 bp, Artificial Sequence
  Synthetic Oligonucleotide
aatggacaggtcaa

SEQ ID NO: 145 - DNA, 16 bp, Artificial Sequence
  Synthetic Oligonucleotide
gttttgaatggacagg

SEQ ID NO: 146 - DNA, 14 bp, Artificial Sequence
  Synthetic Oligonucleotide
ttttgaatggacag

SEQ ID NO: 147 - DNA, 16 bp, Artificial Sequence
  Synthetic Oligonucleotide
tggtagttttgaatgg

SEQ ID NO: 148 - DNA, 14 bp, Artificial Sequence
  Synthetic Oligonucleotide
ggtagttttgaatg

SEQ ID NO: 149 - DNA, 14 bp, Artificial Sequence
  Synthetic Oligonucleotide
tcactgtatggttt

SEQ ID NO: 150 - DNA, 14 bp, Artificial Sequence
  Synthetic Oligonucleotide
ctcactgtatggtt

SEQ ID NO: 151 - DNA, 14 bp, Artificial Sequence
  Synthetic Oligonucleotide
gctcactgtatggt

SEQ ID NO: 152 - DNA, 14 bp, Artificial Sequence
  Synthetic Oligonucleotide
ggctcactgtatgg

SEQ ID NO: 153 - DNA, 14 bp, Artificial Sequence
  Synthetic Oligonucleotide
tggctcactgtatg

SEQ ID NO: 154 - DNA, 14 bp, Artificial Sequence
  Synthetic Oligonucleotide
ctggctcactgtat

SEQ ID NO: 155 - DNA, 14 bp, Artificial Sequence
  Synthetic Oligonucleotide
gctggctcactgta

SEQ ID NO: 156 - DNA, 14 bp, Artificial Sequence
  Synthetic Oligonucleotide
ggctggctcactgt

SEQ ID NO: 157 - DNA, 14 bp, Artificial Sequence
  Synthetic Oligonucleotide
aggctggctcactg

SEQ ID NO: 158 - DNA, 14 bp, Artificial Sequence
  Synthetic Oligonucleotide
caggtccagttcat

SEQ ID NO: 159 - DNA, 14 bp, Artificial Sequence
  Synthetic Oligonucleotide
gcaggtccagttca

SEQ ID NO: 160 - DNA, 14 bp, Artificial Sequence
  Synthetic Oligonucleotide
tgcaggtccagttc

SEQ ID NO: 161 - DNA, 14 bp, Artificial Sequence
  Synthetic Oligonucleotide
gtgcaggtccagtt

SEQ ID NO: 162 - DNA, 14 bp, Artificial Sequence
  Synthetic Oligonucleotide
ggtgcaggtccagt

SEQ ID NO: 163 - DNA, 14 bp, Artificial Sequence
  Synthetic Oligonucleotide
tggtgcaggtccag

SEQ ID NO: 164 - DNA, 14 bp, Artificial Sequence
  Synthetic Oligonucleotide
ttggtgcaggtcca

SEQ ID NO: 165 - DNA, 14 bp, Artificial Sequence
  Synthetic Oligonucleotide
tttggtgcaggtcc

SEQ ID NO: 166 - DNA, 14 bp, Artificial Sequence
  Synthetic Oligonucleotide
ctttggtgcaggtc

SEQ ID NO: 167 - DNA, 14 bp, Artificial Sequence
  Synthetic Oligonucleotide
taactcagatcctg

SEQ ID NO: 168 - DNA, 14 bp, Artificial Sequence
  Synthetic Oligonucleotide
ataactcagatcct

SEQ ID NO: 169 - DNA, 14 bp, Artificial Sequence
  Synthetic Oligonucleotide
aataactcagatcc

SEQ ID NO: 170 - DNA, 14 bp, Artificial Sequence
  Synthetic Oligonucleotide
aaataactcagatc

SEQ ID NO: 171 - DNA, 14 bp, Artificial Sequence
  Synthetic Oligonucleotide
aaaataactcagat

SEQ ID NO: 172 - DNA, 14 bp, Artificial Sequence
  Synthetic Oligonucleotide
caaaataactcaga

SEQ ID NO: 173 - DNA, 14 bp, Artificial Sequence
  Synthetic Oligonucleotide
gcaaaataactcag

SEQ ID NO: 174 - DNA, 14 bp, Artificial Sequence
  Synthetic Oligonucleotide
agcaaaataactca

SEQ ID NO: 175 - DNA, 14 bp, Artificial Sequence
  Synthetic Oligonucleotide
tagcaaaataactc

SEQ ID NO: 176 - DNA, 14 bp, Artificial Sequence
  Synthetic Oligonucleotide
cagggcctggagag

SEQ ID NO: 177 - DNA, 16 bp, Artificial Sequence
  Synthetic Oligonucleotide
tctgaagtccatgatc

SEQ ID NO: 178 - DNA, 14 bp, Artificial Sequence
  Synthetic Oligonucleotide
ctgaagtccatgat

SEQ ID NO: 179 - DNA, 16 bp, Artificial Sequence
  Synthetic Oligonucleotide
tgggcatgattccatt

SEQ ID NO: 180 - DNA, 14 bp, Artificial Sequence
  Synthetic Oligonucleotide
gggcatgattccat

SEQ ID NO: 181 - DNA, 14 bp, Artificial Sequence
  Synthetic Oligonucleotide
tggagcccacgtgc

SEQ ID NO: 182 - DNA, 16 bp, Artificial Sequence
  Synthetic Oligonucleotide
ttgaagttgagggctg

SEQ ID NO: 183 - DNA, 14 bp, Artificial Sequence
  Synthetic Oligonucleotide
tgaagttgagggct

SEQ ID NO: 184 - DNA, 16 bp, Artificial Sequence
  Synthetic Oligonucleotide
accagtattaattttg

SEQ ID NO: 185 - DNA, 14 bp, Artificial Sequence
  Synthetic Oligonucleotide
ccagtattaatttt

SEQ ID NO: 186 - DNA, 16 bp, Artificial Sequence
  Synthetic Oligonucleotide
gtgttctttgaagcgg

SEQ ID NO: 187 - DNA, 14 bp, Artificial Sequence
  Synthetic Oligonucleotide
tgttctttgaagcg

SEQ ID NO: 188 - DNA, 14 bp, Artificial Sequence
  Synthetic Oligonucleotide
agttactttggtgt

SEQ ID NO: 189 - DNA, 16 bp, Artificial Sequence
  Synthetic Oligonucleotide
tggtacatggaagtct

SEQ ID NO: 190 - DNA, 14 bp, Artificial Sequence
  Synthetic Oligonucleotide
ggtacatggaagtc

SEQ ID NO: 191-199 - skipped (9 entries)

SEQ ID NO: 200 - DNA, 14 bp, Artificial Sequence
  Synthetic Oligonucleotide
tccatgccatatgt

SEQ ID NO: 201 - DNA, 16 bp, Artificial Sequence
  Synthetic Oligonucleotide
ccctgaagaagtccat

SEQ ID NO: 202 - DNA, 14 bp, Artificial Sequence
  Synthetic Oligonucleotide
cctgaagaagtcca

SEQ ID NO: 203 - DNA, 16 bp, Artificial Sequence
  Synthetic Oligonucleotide
gcccagttccatgacc

SEQ ID NO: 204 - DNA, 14 bp, Artificial Sequence
  Synthetic Oligonucleotide
cccagttccatgac

SEQ ID NO: 205 - DNA, 16 bp, Artificial Sequence
  Synthetic Oligonucleotide
ttgaggaagccagatt

SEQ ID NO: 206 - DNA, 14 bp, Artificial Sequence
  Synthetic Oligonucleotide
tgaggaagccagat

SEQ ID NO: 207 - DNA, 16 bp, Artificial Sequence
  Synthetic Oligonucleotide
tggatgcagtaatctc

SEQ ID NO: 208 - DNA, 14 bp, Artificial Sequence
  Synthetic Oligonucleotide
ggatgcagtaatct

SEQ ID NO: 209 - DNA, 16 bp, Artificial Sequence
  Synthetic Oligonucleotide
tataaagtccagcatt

SEQ ID NO: 210 - DNA, 14 bp, Artificial Sequence
  Synthetic Oligonucleotide
ataaagtccagcat

SEQ ID NO: 211 - DNA, 16 bp, Artificial Sequence
  Synthetic Oligonucleotide
aagttcctgcttgaag

SEQ ID NO: 212 - DNA, 14 bp, Artificial Sequence
  Synthetic Oligonucleotide
agttcctgcttgaa

SEQ ID NO: 213 - DNA, 14 bp, Artificial Sequence
  Synthetic Oligonucleotide
aatggtgaagtact

SEQ ID NO: 214 - DNA, 12 bp, Artificial Sequence
  Synthetic Oligonucleotide
tgtcagcaggat

SEQ ID NO: 215 - DNA, 12 bp, Artificial Sequence
  Synthetic Oligonucleotide
cagcaggaaata

SEQ ID NO: 216 - DNA, 12 bp, Artificial Sequence
  Synthetic Oligonucleotide
ccagcaggaaat

SEQ ID NO: 217 - DNA, 12 bp, Artificial Sequence
  Synthetic Oligonucleotide
accagcaggaaa

SEQ ID NO: 218 - DNA, 12 bp, Artificial Sequence
  Synthetic Oligonucleotide
gaccagcaggaa

SEQ ID NO: 219 - DNA, 12 bp, Artificial Sequence
  Synthetic Oligonucleotide
tgaccagcagga

SEQ ID NO: 220 - skipped

SEQ ID NO: 221 - DNA, 12 bp, Artificial Sequence
  Synthetic Oligonucleotide
atgaccagcagg

SEQ ID NO: 222 - DNA, 12 bp, Artificial Sequence
  Synthetic Oligonucleotide
aatgaccagcag

SEQ ID NO: 223 - DNA, 12 bp, Artificial Sequence
  Synthetic Oligonucleotide
caatgaccagca

SEQ ID NO: 224 - DNA, 12 bp, Artificial Sequence
  Synthetic Oligonucleotide
ccaatgaccagc

SEQ ID NO: 225 - DNA, 12 bp, Artificial Sequence
  Synthetic Oligonucleotide
accacaagccaa

SEQ ID NO: 226 - DNA, 12 bp, Artificial Sequence
  Synthetic Oligonucleotide
tagccgcccaca

SEQ ID NO: 227 - skipped

SEQ ID NO: 228 - DNA, 12 bp, Artificial Sequence
  Synthetic Oligonucleotide
ccggccaccaca

SEQ ID NO: 229 - DNA, 12 bp, Artificial Sequence
  Synthetic Oligonucleotide
accggccaccac

SEQ ID NO: 230 - DNA, 12 bp, Artificial Sequence
  Synthetic Oligonucleotide
gatgttgctggc

SEQ ID NO: 231 - skipped

SEQ ID NO: 232 - DNA, 12 bp, Artificial Sequence
  Synthetic Oligonucleotide
cgatgttgctgg

SEQ ID NO: 233 - DNA, 12 bp, Artificial Sequence
  Synthetic Oligonucleotide
ccgatgttgctg

SEQ ID NO: 234 - DNA, 12 bp, Artificial Sequence
  Synthetic Oligonucleotide
gccgatgttgct

SEQ ID NO: 235 - DNA, 12 bp, Artificial Sequence
  Synthetic Oligonucleotide
tgccgatgttgc

SEQ ID NO: 236 - DNA, 12 bp, Artificial Sequence
  Synthetic Oligonucleotide
ctgccgatgttg

SEQ ID NO: 237 - DNA, 12 bp, Artificial Sequence
  Synthetic Oligonucleotide
caggcccacaaa

SEQ ID NO: 238 - DNA, 12 bp, Artificial Sequence
  Synthetic Oligonucleotide
ccaggcccacaa

SEQ ID NO: 239 - DNA, 12 bp, Artificial Sequence
  Synthetic Oligonucleotide
gccaggcccaca

SEQ ID NO: 240 - DNA, 12 bp, Artificial Sequence
  Synthetic Oligonucleotide
ccaagccacttg

SEQ ID NO: 241 - DNA, 12 bp, Artificial Sequence
  Synthetic Oligonucleotide
agagcgcattcc

SEQ ID NO: 242 - DNA, 12 bp, Artificial Sequence
  Synthetic Oligonucleotide
acaggtagaggc

SEQ ID NO: 243 - DNA, 12 bp, Artificial Sequence
  Synthetic Oligonucleotide
agatcttggtga

SEQ ID NO: 244 - skipped

SEQ ID NO: 245 - DNA, 13 bp, Artificial Sequence
  Synthetic Oligonucleotide
tgttccagcccag

SEQ ID NO: 246 - DNA, 12 bp, Artificial Sequence
  Synthetic Oligonucleotide
tgttccagccca

SEQ ID NO: 247-250 - skipped (4 entries)

SEQ ID NO: 251 - DNA, 12 bp, Artificial Sequence
  Synthetic Oligonucleotide
atgttccagccc

SEQ ID NO: 252 - DNA, 12 bp, Artificial Sequence
  Synthetic Oligonucleotide
tggtgatgccca

SEQ ID NO: 253 - DNA, 12 bp, Artificial Sequence
  Synthetic Oligonucleotide
atggtgatgccc

SEQ ID NO: 254 - DNA, 12 bp, Artificial Sequence
  Synthetic Oligonucleotide
catggtgatgcc

SEQ ID NO: 255 - skipped

SEQ ID NO: 256 - DNA, 12 bp, Artificial Sequence
  Synthetic Oligonucleotide
tcatggtgatgc

SEQ ID NO: 257 - DNA, 12 bp, Artificial Sequence
  Synthetic Oligonucleotide
atcatggtgatg

SEQ ID NO: 258 - DNA, 12 bp, Artificial Sequence
  Synthetic Oligonucleotide
ccctcctgtcac

SEQ ID NO: 259 - DNA, 12 bp, Artificial Sequence
  Synthetic Oligonucleotide
gccctcctgtca

SEQ ID NO: 260 - DNA, 12 bp, Artificial Sequence
  Synthetic Oligonucleotide
agccctcctgtc

SEQ ID NO: 261 - DNA, 12 bp, Artificial Sequence
  Synthetic Oligonucleotide
cagccctcctgt

SEQ ID NO: 262 - DNA, 12 bp, Artificial Sequence
  Synthetic Oligonucleotide
ccagccctcctg

SEQ ID NO: 263 - DNA, 12 bp, Artificial Sequence
  Synthetic Oligonucleotide
gccagccctcct

SEQ ID NO: 264 - DNA, 12 bp, Artificial Sequence
  Synthetic Oligonucleotide
gacgaaggtctg

SEQ ID NO: 265 - DNA, 12 bp, Artificial Sequence
  Synthetic Oligonucleotide
gtatttgtcgaa

SEQ ID NO: 266 - DNA, 12 bp, Artificial Sequence
  Synthetic Oligonucleotide
ggacaccgtcag

SEQ ID NO: 267 - DNA, 12 bp, Artificial Sequence
  Synthetic Oligonucleotide
cagcttcaggta

SEQ ID NO: 268 - DNA, 12 bp, Artificial Sequence
  Synthetic Oligonucleotide
catgaccatgag

SEQ ID NO: 269 - DNA, 12 bp, Artificial Sequence
  Synthetic Oligonucleotide
gcatgaccatga

SEQ ID NO: 270 - DNA, 12 bp, Artificial Sequence
  Synthetic Oligonucleotide
ggcatgaccatg

SEQ ID NO: 271 - DNA, 12 bp, Artificial Sequence
  Synthetic Oligonucleotide
tggcatgaccat

SEQ ID NO: 272 - DNA, 12 bp, Artificial Sequence
  Synthetic Oligonucleotide
ctggcatgacca

SEQ ID NO: 273 - skipped

SEQ ID NO: 274 - DNA, 12 bp, Artificial Sequence
  Synthetic Oligonucleotide
cctggcatgacc

SEQ ID NO: 275 - DNA, 12 bp, Artificial Sequence
  Synthetic Oligonucleotide
gcagcccacctc

SEQ ID NO: 276 - DNA, 12 bp, Artificial Sequence
  Synthetic Oligonucleotide
agcagcccacct

SEQ ID NO: 277 - DNA, 12 bp, Artificial Sequence
  Synthetic Oligonucleotide
gagcagcccacc

SEQ ID NO: 278 - DNA, 12 bp, Artificial Sequence
  Synthetic Oligonucleotide
catgagcttcac

SEQ ID NO: 279 - DNA, 12 bp, Artificial Sequence
  Synthetic Oligonucleotide
gcatgagcttca

SEQ ID NO: 280 - DNA, 13 bp, Artificial Sequence
  Synthetic Oligonucleotide
ggcatgagcttca

SEQ ID NO: 281 - DNA, 12 bp, Artificial Sequence
  Synthetic Oligonucleotide
ggcatgagcttc

SEQ ID NO: 282 - skipped

SEQ ID NO: 283 - DNA, 12 bp, Artificial Sequence
  Synthetic Oligonucleotide
gggcatgagctt

SEQ ID NO: 284 - DNA, 12 bp, Artificial Sequence
  Synthetic Oligonucleotide
cagcatgagtcc

SEQ ID NO: 285 - DNA, 12 bp, Artificial Sequence
  Synthetic Oligonucleotide
ccagcatgagtc

SEQ ID NO: 286 - skipped

SEQ ID NO: 287 - DNA, 12 bp, Artificial Sequence
  Synthetic Oligonucleotide
gccagcatgagt

SEQ ID NO: 288 - DNA, 12 bp, Artificial Sequence
  Synthetic Oligonucleotide
ccatggtgaaga

SEQ ID NO: 289 - DNA, 12 bp, Artificial Sequence
  Synthetic Oligonucleotide
cacagctgcccg

SEQ ID NO: 290 - DNA, 12 bp, Artificial Sequence
  Synthetic Oligonucleotide
acacagctgccc

SEQ ID NO: 291 - DNA, 12 bp, Artificial Sequence
  Synthetic Oligonucleotide
cacacagctgcc

SEQ ID NO: 292 - DNA, 13 bp, Artificial Sequence
  Synthetic Oligonucleotide
gcacacagctgcc

SEQ ID NO: 293 - DNA, 12 bp, Artificial Sequence
  Synthetic Oligonucleotide
gcacacagctgc

SEQ ID NO: 294 - skipped

SEQ ID NO: 295 - DNA, 12 bp, Artificial Sequence
  Synthetic Oligonucleotide
gccggagactga

SEQ ID NO: 296 - DNA, 12 bp, Artificial Sequence
  Synthetic Oligonucleotide
attgaggttgac

SEQ ID NO: 297 - DNA, 12 bp, Artificial Sequence
  Synthetic Oligonucleotide
cattgaggttga

SEQ ID NO: 298 - DNA, 12 bp, Artificial Sequence
  Synthetic Oligonucleotide
gcattgaggttg

SEQ ID NO: 299 - DNA, 12 bp, Artificial Sequence
  Synthetic Oligonucleotide
ggcattgaggtt

SEQ ID NO: 300 - DNA, 12 bp, Artificial Sequence
  Synthetic Oligonucleotide
gggcattgaggt

SEQ ID NO: 301-328 - skipped (28 entries)

SEQ ID NO: 329 - DNA, 14 bp, Artificial Sequence
  Synthetic Oligonucleotide
atggggcaacttca

SEQ ID NO: 330 - DNA, 14 bp, Artificial Sequence
  Synthetic Oligonucleotide
catggggcaacttc

SEQ ID NO: 331 - DNA, 14 bp, Artificial Sequence
  Synthetic Oligonucleotide
acatggggcaactt

SEQ ID NO: 332 - DNA, 14 bp, Artificial Sequence
  Synthetic Oligonucleotide
gggatgctctgggc

SEQ ID NO: 333 - DNA, 14 bp, Artificial Sequence
  Synthetic Oligonucleotide
cgctccaggttcca

SEQ ID NO: 334 - DNA, 14 bp, Artificial Sequence
  Synthetic Oligonucleotide
gatacacctccacc

SEQ ID NO: 335 - DNA, 14 bp, Artificial Sequence
  Synthetic Oligonucleotide
agatacacctccac

SEQ ID NO: 336 - DNA, 14 bp, Artificial Sequence
  Synthetic Oligonucleotide
gagatacacctcca

SEQ ID NO: 337 - DNA, 14 bp, Artificial Sequence
  Synthetic Oligonucleotide
gcctgtctgtggaa

SEQ ID NO: 338 - DNA, 14 bp, Artificial Sequence
  Synthetic Oligonucleotide
ctgtcacacttgct

SEQ ID NO: 339 - DNA, 14 bp, Artificial Sequence
  Synthetic Oligonucleotide
cggccgctgaccac

SEQ ID NO: 340 - DNA, 14 bp, Artificial Sequence
  Synthetic Oligonucleotide
ccggccgctgacca

SEQ ID NO: 341 - DNA, 14 bp, Artificial Sequence
  Synthetic Oligonucleotide
cccggccgctgacc

SEQ ID NO: 342 - DNA, 14 bp, Artificial Sequence
  Synthetic Oligonucleotide
tcccggccgctgac

SEQ ID NO: 343 - DNA, 14 bp, Artificial Sequence
  Synthetic Oligonucleotide
atcccggccgctga

SEQ ID NO: 344 - DNA, 14 bp, Artificial Sequence
  Synthetic Oligonucleotide
catcccggccgctg

SEQ ID NO: 345 - DNA, 14 bp, Artificial Sequence
  Synthetic Oligonucleotide
gcatcccggccgct

SEQ ID NO: 346 - DNA, 14 bp, Artificial Sequence
  Synthetic Oligonucleotide
gtgcccttcccttg

SEQ ID NO: 347 - DNA, 14 bp, Artificial Sequence
  Synthetic Oligonucleotide
atgagggtgccgct

SEQ ID NO: 348 - DNA, 14 bp, Artificial Sequence
  Synthetic Oligonucleotide
tatgagggtgccgc

SEQ ID NO: 349 - DNA, 14 bp, Artificial Sequence
  Synthetic Oligonucleotide
ctatgagggtgccg

SEQ ID NO: 350 - DNA, 14 bp, Artificial Sequence
  Synthetic Oligonucleotide
cctatgagggtgcc

SEQ ID NO: 351 - DNA, 14 bp, Artificial Sequence
  Synthetic Oligonucleotide
cgaataaactccag

SEQ ID NO: 352 - DNA, 14 bp, Artificial Sequence
  Synthetic Oligonucleotide
ccgaataaactcca

SEQ ID NO: 353 - DNA, 14 bp, Artificial Sequence
  Synthetic Oligonucleotide
tccgaataaactcc

SEQ ID NO: 354 - DNA, 14 bp, Artificial Sequence
  Synthetic Oligonucleotide
ttccgaataaactc

SEQ ID NO: 355 - DNA, 14 bp, Artificial Sequence
  Synthetic Oligonucleotide
gccaggggcagcag

SEQ ID NO: 356 - DNA, 14 bp, Artificial Sequence
  Synthetic Oligonucleotide
gagtagaggcaggc

SEQ ID NO: 357 - DNA, 14 bp, Artificial Sequence
  Synthetic Oligonucleotide
ccccaaagtcccca

SEQ ID NO: 358 - DNA, 14 bp, Artificial Sequence
  Synthetic Oligonucleotide
tccccaaagtcccc

SEQ ID NO: 359 - DNA, 14 bp, Artificial Sequence
  Synthetic Oligonucleotide
gtccccaaagtccc

SEQ ID NO: 360 - DNA, 14 bp, Artificial Sequence
  Synthetic Oligonucleotide
acgtgggcagcagc

SEQ ID NO: 361 - DNA, 14 bp, Artificial Sequence
  Synthetic Oligonucleotide
cacgtgggcagcag

SEQ ID NO: 362 - DNA, 14 bp, Artificial Sequence
  Synthetic Oligonucleotide
ccacgtgggcagca

SEQ ID NO: 363 - DNA, 14 bp, Artificial Sequence
  Synthetic Oligonucleotide
gccacgtgggcagc

SEQ ID NO: 364 - DNA, 14 bp, Artificial Sequence
  Synthetic Oligonucleotide
cagggaaccaggcc

SEQ ID NO: 365 - DNA, 14 bp, Artificial Sequence
  Synthetic Oligonucleotide
tcagggaaccaggc

SEQ ID NO: 366 - DNA, 14 bp, Artificial Sequence
  Synthetic Oligonucleotide
ctcagggaaccagg

SEQ ID NO: 367 - DNA, 14 bp, Artificial Sequence
  Synthetic Oligonucleotide
cctcagggaaccag

SEQ ID NO: 368 - DNA, 14 bp, Artificial Sequence
  Synthetic Oligonucleotide
tcctcagggaacca

SEQ ID NO: 369 - DNA, 14 bp, Artificial Sequence
  Synthetic Oligonucleotide
gtcctcagggaacc

SEQ ID NO: 370 - DNA, 14 bp, Artificial Sequence
  Synthetic Oligonucleotide
ggtcctcagggaac

SEQ ID NO: 371 - DNA, 14 bp, Artificial Sequence
  Synthetic Oligonucleotide
tggtcctcagggaa

SEQ ID NO: 372 - DNA, 14 bp, Artificial Sequence
  Synthetic Oligonucleotide
ctggtcctcaggga

SEQ ID NO: 373 - DNA, 14 bp, Artificial Sequence
  Synthetic Oligonucleotide
gctggtcctcaggg

SEQ ID NO: 374 - DNA, 14 bp, Artificial Sequence
  Synthetic Oligonucleotide
gtgctggggggcag

SEQ ID NO: 375 - DNA, 14 bp, Artificial Sequence
  Synthetic Oligonucleotide
ggtgctggggggca

SEQ ID NO: 376 - DNA, 14 bp, Artificial Sequence
  Synthetic Oligonucleotide
gggtgctggggggc

SEQ ID NO: 377 - DNA, 14 bp, Artificial Sequence
  Synthetic Oligonucleotide
tgggtgctgggggg

SEQ ID NO: 378 - DNA, 14 bp, Artificial Sequence
  Synthetic Oligonucleotide
gagcagctcagcag

SEQ ID NO: 379 - DNA, 14 bp, Artificial Sequence
  Synthetic Oligonucleotide
ggagcagctcagca

SEQ ID NO: 380 - DNA, 14 bp, Artificial Sequence
  Synthetic Oligonucleotide
tggagcagctcagc

SEQ ID NO: 381 - DNA, 14 bp, Artificial Sequence
  Synthetic Oligonucleotide
ctggagcagctcag

SEQ ID NO: 382 - DNA, 14 bp, Artificial Sequence
  Synthetic Oligonucleotide
ccctcacccccaaa

SEQ ID NO: 383 - DNA, 14 bp, Artificial Sequence
  Synthetic Oligonucleotide
accctcacccccaa

SEQ ID NO: 384 - DNA, 14 bp, Artificial Sequence
  Synthetic Oligonucleotide
caccctcaccccca

SEQ ID NO: 385 - DNA, 14 bp, Artificial Sequence
  Synthetic Oligonucleotide
acaccctcaccccc

SEQ ID NO: 386 - DNA, 14 bp, Artificial Sequence
  Synthetic Oligonucleotide
gacaccctcacccc

SEQ ID NO: 387 - DNA, 14 bp, Artificial Sequence
  Synthetic Oligonucleotide
agacaccctcaccc

SEQ ID NO: 388 - DNA, 14 bp, Artificial Sequence
  Synthetic Oligonucleotide
tagacaccctcacc

SEQ ID NO: 389 - DNA, 14 bp, Artificial Sequence
  Synthetic Oligonucleotide
tggcagcaggaagc

SEQ ID NO: 390 - DNA, 14 bp, Artificial Sequence
  Synthetic Oligonucleotide
atggcagcaggaag

SEQ ID NO: 391 - DNA, 14 bp, Artificial Sequence
  Synthetic Oligonucleotide
catggcagcaggaa

SEQ ID NO: 392 - DNA, 14 bp, Artificial Sequence
  Synthetic Oligonucleotide
gcatggcagcagga

SEQ ID NO: 393 - DNA, 14 bp, Artificial Sequence
  Synthetic Oligonucleotide
ggcagcagatggca

SEQ ID NO: 394 - DNA, 14 bp, Artificial Sequence
  Synthetic Oligonucleotide
cggcagcagatggc

SEQ ID NO: 395 - DNA, 14 bp, Artificial Sequence
  Synthetic Oligonucleotide
ccggcagcagatgg

SEQ ID NO: 396 - DNA, 14 bp, Artificial Sequence
  Synthetic Oligonucleotide
tccggcagcagatg

SEQ ID NO: 397 - DNA, 14 bp, Artificial Sequence
  Synthetic Oligonucleotide
ctccggcagcagat

SEQ ID NO: 398 - DNA, 14 bp, Artificial Sequence
  Synthetic Oligonucleotide
gctccggcagcaga

SEQ ID NO: 399 - DNA, 14 bp, Artificial Sequence
  Synthetic Oligonucleotide
ggctccggcagcag

SEQ ID NO: 400 - DNA, 14 bp, Artificial Sequence
  Synthetic Oligonucleotide
cggctccggcagca

SEQ ID NO: 401 - DNA, 14 bp, Artificial Sequence
  Synthetic Oligonucleotide
ccggctccggcagc

SEQ ID NO: 402 - DNA, 14 bp, Artificial Sequence
  Synthetic Oligonucleotide
gccggctccggcag

SEQ ID NO: 403 - DNA, 14 bp, Artificial Sequence
  Synthetic Oligonucleotide
agttacaaaagcaa

SEQ ID NO: 404-405 - skipped (2 entries)

SEQ ID NO: 406 - DNA, 16 bp, Artificial Sequence
  Synthetic Oligonucleotide
gtcgcccttcagcacg

SEQ ID NO: 407 - DNA, 14 bp, Artificial Sequence
  Synthetic Oligonucleotide
tcgcccttcagcac

SEQ ID NO: 408 - DNA, 12 bp, Artificial Sequence
  Synthetic Oligonucleotide
cgcccttcagca

SEQ ID NO: 409 - DNA, 16 bp, Artificial Sequence
  Synthetic Oligonucleotide
actctggacccaaacc

SEQ ID NO: 410 - DNA, 14 bp, Artificial Sequence
  Synthetic Oligonucleotide
ctctggacccaaac

SEQ ID NO: 411 - DNA, 16 bp, Artificial Sequence
  Synthetic Oligonucleotide
ccatttcaggagacct

SEQ ID NO: 412 - DNA, 14 bp, Artificial Sequence
  Synthetic Oligonucleotide
catttcaggagacc

SEQ ID NO: 413 - DNA, 14 bp, Artificial Sequence
  Synthetic Oligonucleotide
tttgggaggtggtc

SEQ ID NO: 414 - DNA, 14 bp, Artificial Sequence
  Synthetic Oligonucleotide
cacaccaggcagag

SEQ ID NO: 415 - DNA, 14 bp, Artificial Sequence
  Synthetic Oligonucleotide
ctttacagcttcca

SEQ ID NO: 416 - DNA, 14 bp, Artificial Sequence
  Synthetic Oligonucleotide
cactaccttccact

SEQ ID NO: 417 - DNA, 14 bp, Artificial Sequence
  Synthetic Oligonucleotide
aacacacactacct

SEQ ID NO: 418 - DNA, 14 bp, Artificial Sequence
  Synthetic Oligonucleotide
ctcttcaaaacaca

SEQ ID NO: 419 - DNA, 14 bp, Artificial Sequence
  Synthetic Oligonucleotide
gtaattgtgctgtc

SEQ ID NO: 420 - DNA, 14 bp, Artificial Sequence
  Synthetic Oligonucleotide
tttttcttcgaatt

SEQ ID NO: 421 - DNA, 14 bp, Artificial Sequence
  Synthetic Oligonucleotide
cattttcgatagcg

SEQ ID NO: 422 - DNA, 14 bp, Artificial Sequence
  Synthetic Oligonucleotide
accttccaggttca

SEQ ID NO: 423 - DNA, 14 bp, Artificial Sequence
  Synthetic Oligonucleotide
ataggaagcataaa

SEQ ID NO: 424 - DNA, 14 bp, Artificial Sequence
  Synthetic Oligonucleotide
tcttttaaagaaga

SEQ ID NO: 425 - DNA, 14 bp, Artificial Sequence
  Synthetic Oligonucleotide
aaggatattttaaa

SEQ ID NO: 426 - skipped

SEQ ID NO: 427 - DNA, 14 bp, Artificial Sequence
  Synthetic Oligonucleotide
gaacaaaaattaaa

SEQ ID NO: 428 - DNA, 14 bp, Artificial Sequence
  Synthetic Oligonucleotide
ttccacagatctgt

SEQ ID NO: 429 - DNA, 14 bp, Artificial Sequence
  Synthetic Oligonucleotide
tttataaagtaaag

SEQ ID NO: 430-432 - skipped (3 entries)

SEQ ID NO: 433 - DNA, 14 bp, Artificial Sequence
  Synthetic Oligonucleotide
tactgtgagaaata

SEQ ID NO: 434 - skipped

SEQ ID NO: 435 - DNA, 14 bp, Artificial Sequence
  Synthetic Oligonucleotide
ttccagcttgaaga

SEQ ID NO: 436 - DNA, 14 bp, Artificial Sequence
  Synthetic Oligonucleotide
gatcagttctcatg

SEQ ID NO: 437-438 - skipped (2 entries)

SEQ ID NO: 439 - DNA, 14 bp, Artificial Sequence
  Synthetic Oligonucleotide
ttatcaatgatgca

SEQ ID NO: 440 - DNA, 14 bp, Artificial Sequence
  Synthetic Oligonucleotide
gcatgctggacagt

SEQ ID NO: 441-442 - skipped (2 entries)

SEQ ID NO: 443 - DNA, 14 bp, Artificial Sequence
  Synthetic Oligonucleotide
ttgcacctgaacta

SEQ ID NO: 444 - DNA, 14 bp, Artificial Sequence
  Synthetic Oligonucleotide
cagaatatatttct

SEQ ID NO: 445-449 - skipped (5 entries)

SEQ ID NO: 450 - DNA, 14 bp, Artificial Sequence
  Synthetic Oligonucleotide
ataagagattaaaa

SEQ ID NO: 451 - DNA, 14 bp, Artificial Sequence
  Synthetic Oligonucleotide
tcccccttctcatt

SEQ ID NO: 452 - DNA, 14 bp, Artificial Sequence
  Synthetic Oligonucleotide
gggcattgttaaaa

SEQ ID NO: 453-454 - skipped (2 entries)

SEQ ID NO: 455 - DNA, 14 bp, Artificial Sequence
  Synthetic Oligonucleotide
agaactcacatctg

SEQ ID NO: 456 - DNA, 14 bp, Artificial Sequence
  Synthetic Oligonucleotide
gagctggacggagg

SEQ ID NO: 457 - DNA, 14 bp, Artificial Sequence
  Synthetic Oligonucleotide
aagcttcatcggag

SEQ ID NO: 458 - DNA, 14 bp, Artificial Sequence
  Synthetic Oligonucleotide
ataatggcatcccg

SEQ ID NO: 459 - skipped

SEQ ID NO: 460 - DNA, 14 bp, Artificial Sequence
  Synthetic Oligonucleotide
tgctgtcctataag

SEQ ID NO: 461 - DNA, 14 bp, Artificial Sequence
  Synthetic Oligonucleotide
cacaaaggtaattg

SEQ ID NO: 462 - DNA, 14 bp, Artificial Sequence
  Synthetic Oligonucleotide
atcatttcttccag

SEQ ID NO: 463-465 - skipped (3 entries)

SEQ ID NO: 466 - DNA, 14 bp, Artificial Sequence
  Synthetic Oligonucleotide
ccattaccttccag

SEQ ID NO: 467 - DNA, 14 bp, Artificial Sequence
  Synthetic Oligonucleotide
gcataaacagggtt

SEQ ID NO: 468-471 - skipped (4 entries)

SEQ ID NO: 472 - DNA, 14 bp, Artificial Sequence
  Synthetic Oligonucleotide
tatgaaaggaatgt

SEQ ID NO: 473 - skipped

SEQ ID NO: 474 - DNA, 14 bp, Artificial Sequence
  Synthetic Oligonucleotide
ttccttaagcttcc

SEQ ID NO: 475-484 - skipped (10 entries)

SEQ ID NO: 485 - DNA, 14 bp, Artificial Sequence
  Synthetic Oligonucleotide
gaacagttaaacat

SEQ ID NO: 486 - DNA, 16 bp, Artificial Sequence
  Synthetic Oligonucleotide
tagagcttccacttct

SEQ ID NO: 487 - DNA, 14 bp, Artificial Sequence
  Synthetic Oligonucleotide
gagcttccacttct

SEQ ID NO: 488 - DNA, 14 bp, Artificial Sequence
  Synthetic Oligonucleotide
tgttggccgtggta

SEQ ID NO: 489 - DNA, 14 bp, Artificial Sequence
  Synthetic Oligonucleotide
atgttggccgtggt

SEQ ID NO: 490 - DNA, 14 bp, Artificial Sequence
  Synthetic Oligonucleotide
gatgttggccgtgg

SEQ ID NO: 491 - DNA, 14 bp, Artificial Sequence
  Synthetic Oligonucleotide
agatgttggccgtg

SEQ ID NO: 492 - DNA, 14 bp, Artificial Sequence
  Synthetic Oligonucleotide
gagatgttggccgt

SEQ ID NO: 493 - DNA, 14 bp, Artificial Sequence
  Synthetic Oligonucleotide
ggagatgttggccg

SEQ ID NO: 494 - DNA, 14 bp, Artificial Sequence
  Synthetic Oligonucleotide
aggagatgttggcc

SEQ ID NO: 495 - DNA, 14 bp, Artificial Sequence
  Synthetic Oligonucleotide
caggagatgttggc

SEQ ID NO: 496 - DNA, 14 bp, Artificial Sequence
  Synthetic Oligonucleotide
gcaggagatgttgg

SEQ ID NO: 497 - DNA, 14 bp, Artificial Sequence
  Synthetic Oligonucleotide
ggcaggagatgttg

SEQ ID NO: 498 - DNA, 14 bp, Artificial Sequence
  Synthetic Oligonucleotide
gtggtgccaaggca

SEQ ID NO: 499 - DNA, 14 bp, Artificial Sequence
  Synthetic Oligonucleotide
tgtggtgccaaggc

SEQ ID NO: 500 - DNA, 14 bp, Artificial Sequence
  Synthetic Oligonucleotide
ttgtggtgccaagg

SEQ ID NO: 501 - DNA, 14 bp, Artificial Sequence
  Synthetic Oligonucleotide
tttgtggtgccaag

SEQ ID NO: 502 - DNA, 14 bp, Artificial Sequence
  Synthetic Oligonucleotide
ctttgtggtgccaa

SEQ ID NO: 503 - DNA, 14 bp, Artificial Sequence
  Synthetic Oligonucleotide
actttgtggtgcca

SEQ ID NO: 504 - DNA, 14 bp, Artificial Sequence
  Synthetic Oligonucleotide
cactttgtggtgcc

SEQ ID NO: 505 - DNA, 14 bp, Artificial Sequence
  Synthetic Oligonucleotide
gcactttgtggtgc

SEQ ID NO: 506 - DNA, 14 bp, Artificial Sequence
  Synthetic Oligonucleotide
tgcactttgtggtg

SEQ ID NO: 507 - DNA, 14 bp, Artificial Sequence
  Synthetic Oligonucleotide
ttgcactttgtggt

SEQ ID NO: 508 - DNA, 14 bp, Artificial Sequence
  Synthetic Oligonucleotide
cggtgttgcacttt

SEQ ID NO: 509 - DNA, 14 bp, Artificial Sequence
  Synthetic Oligonucleotide
gcggtgttgcactt

SEQ ID NO: 510 - DNA, 14 bp, Artificial Sequence
  Synthetic Oligonucleotide
agcggtgttgcact

SEQ ID NO: 511 - DNA, 14 bp, Artificial Sequence
  Synthetic Oligonucleotide
aagcggtgttgcac

SEQ ID NO: 512 - DNA, 14 bp, Artificial Sequence
  Synthetic Oligonucleotide
gaagcggtgttgca

SEQ ID NO: 513 - DNA, 14 bp, Artificial Sequence
  Synthetic Oligonucleotide
cgaagcggtgttgc

SEQ ID NO: 514 - DNA, 14 bp, Artificial Sequence
  Synthetic Oligonucleotide
acgaagcggtgttg

SEQ ID NO: 515 - DNA, 14 bp, Artificial Sequence
  Synthetic Oligonucleotide
cacgaagcggtgtt

SEQ ID NO: 516 - DNA, 14 bp, Artificial Sequence
  Synthetic Oligonucleotide
acacgaagcggtgt

SEQ ID NO: 517 - DNA, 14 bp, Artificial Sequence
  Synthetic Oligonucleotide
aacacgaagcggtg

SEQ ID NO: 518 - DNA, 14 bp, Artificial Sequence
  Synthetic Oligonucleotide
gctgctgtacatct

SEQ ID NO: 519 - skipped

SEQ ID NO: 520 - DNA, 14 bp, Artificial Sequence
  Synthetic Oligonucleotide
agctgctgtacatc

SEQ ID NO: 521 - DNA, 14 bp, Artificial Sequence
  Synthetic Oligonucleotide
aagctgctgtacat

SEQ ID NO: 522 - DNA, 14 bp, Artificial Sequence
  Synthetic Oligonucleotide
gaagctgctgtaca

SEQ ID NO: 523 - DNA, 14 bp, Artificial Sequence
  Synthetic Oligonucleotide
ggaagctgctgtac

SEQ ID NO: 524 - DNA, 14 bp, Artificial Sequence
  Synthetic Oligonucleotide
tggaagctgctgta

SEQ ID NO: 525 - DNA, 14 bp, Artificial Sequence
  Synthetic Oligonucleotide
ctggaagctgctgt

SEQ ID NO: 526 - DNA, 14 bp, Artificial Sequence
  Synthetic Oligonucleotide
cctggaagctgctg

SEQ ID NO: 527 - DNA, 14 bp, Artificial Sequence
  Synthetic Oligonucleotide
acctggaagctgct

SEQ ID NO: 528 - DNA, 14 bp, Artificial Sequence
  Synthetic Oligonucleotide
cacctggaagctgc

SEQ ID NO: 529 - DNA, 14 bp, Artificial Sequence
  Synthetic Oligonucleotide
tcacctggaagctg

SEQ ID NO: 530 - DNA, 14 bp, Artificial Sequence
  Synthetic Oligonucleotide
atcacctggaagct

SEQ ID NO: 531 - DNA, 14 bp, Artificial Sequence
  Synthetic Oligonucleotide
catcacctggaagc

SEQ ID NO: 532 - DNA, 14 bp, Artificial Sequence
  Synthetic Oligonucleotide
acatcacctggaag

SEQ ID NO: 533 - DNA, 14 bp, Artificial Sequence
  Synthetic Oligonucleotide
tacatcacctggaa

SEQ ID NO: 534 - DNA, 14 bp, Artificial Sequence
  Synthetic Oligonucleotide
gtacatcacctgga

SEQ ID NO: 535 - DNA, 14 bp, Artificial Sequence
  Synthetic Oligonucleotide
tgtacatcacctgg

SEQ ID NO: 536 - DNA, 14 bp, Artificial Sequence
  Synthetic Oligonucleotide
gtgtacatcacctg

SEQ ID NO: 537 - DNA, 14 bp, Artificial Sequence
  Synthetic Oligonucleotide
tagcgggtcctgag

SEQ ID NO: 538 - DNA, 14 bp, Artificial Sequence
  Synthetic Oligonucleotide
gtagcgggtcctga

SEQ ID NO: 539 - DNA, 14 bp, Artificial Sequence
  Synthetic Oligonucleotide
tgtagcgggtcctg

SEQ ID NO: 540 - DNA, 14 bp, Artificial Sequence
  Synthetic Oligonucleotide
ctgtagcgggtcct

SEQ ID NO: 541 - DNA, 14 bp, Artificial Sequence
  Synthetic Oligonucleotide
gctgtagcgggtcc

SEQ ID NO: 542 - DNA, 14 bp, Artificial Sequence
  Synthetic Oligonucleotide
ggctgtagcgggtc

SEQ ID NO: 543 - DNA, 14 bp, Artificial Sequence
  Synthetic Oligonucleotide
tggctgtagcgggt

SEQ ID NO: 544 - DNA, 14 bp, Artificial Sequence
  Synthetic Oligonucleotide
ctggctgtagcggg

SEQ ID NO: 545 - DNA, 14 bp, Artificial Sequence
  Synthetic Oligonucleotide
tctggctgtagcgg

SEQ ID NO: 546 - DNA, 14 bp, Artificial Sequence
  Synthetic Oligonucleotide
ttctggctgtagcg

SEQ ID NO: 547 - DNA, 14 bp, Artificial Sequence
  Synthetic Oligonucleotide
tgaacaccgcggcc

SEQ ID NO: 548 - DNA, 14 bp, Artificial Sequence
  Synthetic Oligonucleotide
atgaacaccgcggc

SEQ ID NO: 549 - DNA, 14 bp, Artificial Sequence
  Synthetic Oligonucleotide
catgaacaccgcgg

SEQ ID NO: 550 - DNA, 14 bp, Artificial Sequence
  Synthetic Oligonucleotide
gcatgaacaccgcg

SEQ ID NO: 551 - DNA, 14 bp, Artificial Sequence
  Synthetic Oligonucleotide
tgcatgaacaccgc

SEQ ID NO: 552 - DNA, 14 bp, Artificial Sequence
  Synthetic Oligonucleotide
ttgcatgaacaccg

SEQ ID NO: 553 - DNA, 14 bp, Artificial Sequence
  Synthetic Oligonucleotide
attgcatgaacacc

SEQ ID NO: 554 - DNA, 14 bp, Artificial Sequence
  Synthetic Oligonucleotide
tattgcatgaacac

SEQ ID NO: 555 - DNA, 14 bp, Artificial Sequence
  Synthetic Oligonucleotide
atattgcatgaaca

SEQ ID NO: 556 - DNA, 14 bp, Artificial Sequence
  Synthetic Oligonucleotide
catattgcatgaac

SEQ ID NO: 557 - DNA, 14 bp, Artificial Sequence
  Synthetic Oligonucleotide
aggttgtgcaggta

SEQ ID NO: 558 - DNA, 14 bp, Artificial Sequence
  Synthetic Oligonucleotide
caggttgtgcaggt

SEQ ID NO: 559 - DNA, 14 bp, Artificial Sequence
  Synthetic Oligonucleotide
gcaggttgtgcagg

SEQ ID NO: 560 - DNA, 14 bp, Artificial Sequence
  Synthetic Oligonucleotide
agcaggttgtgcag

SEQ ID NO: 561 - DNA, 14 bp, Artificial Sequence
  Synthetic Oligonucleotide
cagcaggttgtgca

SEQ ID NO: 562 - DNA, 14 bp, Artificial Sequence
  Synthetic Oligonucleotide
ccagcaggttgtgc

SEQ ID NO: 563 - DNA, 14 bp, Artificial Sequence
  Synthetic Oligonucleotide
cccagcaggttgtg

SEQ ID NO: 564 - DNA, 14 bp, Artificial Sequence
  Synthetic Oligonucleotide
gcccagcaggttgt

SEQ ID NO: 565 - DNA, 14 bp, Artificial Sequence
  Synthetic Oligonucleotide
ggcccagcaggttg

SEQ ID NO: 566 - DNA, 14 bp, Artificial Sequence
  Synthetic Oligonucleotide
aggcccagcaggtt

SEQ ID NO: 567 - DNA, 16 bp, Artificial Sequence
  Synthetic Oligonucleotide
tgtcattgctggtcca

SEQ ID NO: 568 - DNA, 14 bp, Artificial Sequence
  Synthetic Oligonucleotide
tcattgctggtcca

SEQ ID NO: 569 - DNA, 16 bp, Artificial Sequence
  Synthetic Oligonucleotide
tggccagccggaactt

SEQ ID NO: 570 - DNA, 14 bp, Artificial Sequence
  Synthetic Oligonucleotide
gccagccggaactt

SEQ ID NO: 571 - DNA, 16 bp, Artificial Sequence
  Synthetic Oligonucleotide
gggatgagggtcagcg

SEQ ID NO: 572 - DNA, 14 bp, Artificial Sequence
  Synthetic Oligonucleotide
gatgagggtcagcg

SEQ ID NO: 573 - DNA, 14 bp, Artificial Sequence
  Synthetic Oligonucleotide
aaggcaaagaccac

SEQ ID NO: 574 - DNA, 14 bp, Artificial Sequence
  Synthetic Oligonucleotide
ggagcgcagggtgc

SEQ ID NO: 575 - DNA, 14 bp, Artificial Sequence
  Synthetic Oligonucleotide
tgcacctccttgtt

SEQ ID NO: 576 - DNA, 14 bp, Artificial Sequence
  Synthetic Oligonucleotide
cagcagaccctgga

SEQ ID NO: 577 - DNA, 16 bp, Artificial Sequence
  Synthetic Oligonucleotide
acatctggcagaggtt

SEQ ID NO: 578 - DNA, 14 bp, Artificial Sequence
  Synthetic Oligonucleotide
atctggcagaggtt

SEQ ID NO: 579 - DNA, 16 bp, Artificial Sequence
  Synthetic Oligonucleotide
caggccagcaggagta

SEQ ID NO: 580 - DNA, 14 bp, Artificial Sequence
  Synthetic Oligonucleotide
ggccagcaggagta

SEQ ID NO: 581 - DNA, 16 bp, Artificial Sequence
  Synthetic Oligonucleotide
ctcaaacaaaaagtcc

SEQ ID NO: 582 - DNA, 14 bp, Artificial Sequence
  Synthetic Oligonucleotide
caaacaaaaagtcc

SEQ ID NO: 583 - DNA, 16 bp, Artificial Sequence
  Synthetic Oligonucleotide
gtggtgacattggtca

SEQ ID NO: 584 - DNA, 14 bp, Artificial Sequence
  Synthetic Oligonucleotide
ggtgacattggtca

SEQ ID NO: 585-586 - skipped (2 entries)

SEQ ID NO: 587 - DNA, 14 bp, Artificial Sequence
  Synthetic Oligonucleotide
ttggcagtggtgtt

SEQ ID NO: 588 - DNA, 14 bp, Artificial Sequence
  Synthetic Oligonucleotide
atgttggcagtggt

SEQ ID NO: 589 - DNA, 16 bp, Artificial Sequence
  Synthetic Oligonucleotide
aggaaatgttggcagt

SEQ ID NO: 590 - DNA, 14 bp, Artificial Sequence
  Synthetic Oligonucleotide
gaaatgttggcagt

SEQ ID NO: 591 - DNA, 14 bp, Artificial Sequence
  Synthetic Oligonucleotide
caggaaatgttggc

SEQ ID NO: 592 - DNA, 14 bp, Artificial Sequence
  Synthetic Oligonucleotide
gggcaggaaatgtt

SEQ ID NO: 593 - DNA, 14 bp, Artificial Sequence
  Synthetic Oligonucleotide
aaggtaggtaccag

SEQ ID NO: 594 - DNA, 14 bp, Artificial Sequence
  Synthetic Oligonucleotide
accaaggtaggtac

SEQ ID NO: 595 - DNA, 14 bp, Artificial Sequence
  Synthetic Oligonucleotide
ctttgtggcaccaa

SEQ ID NO: 596 - DNA, 14 bp, Artificial Sequence
  Synthetic Oligonucleotide
gcactttgtggcac

SEQ ID NO: 597 - DNA, 14 bp, Artificial Sequence
  Synthetic Oligonucleotide
tgcactttgtggca

SEQ ID NO: 598 - DNA, 14 bp, Artificial Sequence
  Synthetic Oligonucleotide
gctgcactttgtgg

SEQ ID NO: 599 - DNA, 14 bp, Artificial Sequence
  Synthetic Oligonucleotide
ggtgctgcactttg

SEQ ID NO: 600 - DNA, 14 bp, Artificial Sequence
  Synthetic Oligonucleotide
ggcggtgctgcact

SEQ ID NO: 601 - DNA, 14 bp, Artificial Sequence
  Synthetic Oligonucleotide
tgaacactaggcgg

SEQ ID NO: 602 - DNA, 14 bp, Artificial Sequence
  Synthetic Oligonucleotide
tcttgaacactagg

SEQ ID NO: 603 - DNA, 16 bp, Artificial Sequence
  Synthetic Oligonucleotide
cacctcttgaacacta

SEQ ID NO: 604 - DNA, 14 bp, Artificial Sequence
  Synthetic Oligonucleotide
cctcttgaacacta

SEQ ID NO: 605 - DNA, 14 bp, Artificial Sequence
  Synthetic Oligonucleotide
acctcttgaacact

SEQ ID NO: 606 - DNA, 14 bp, Artificial Sequence
  Synthetic Oligonucleotide
cacacctcttgaac

SEQ ID NO: 607 - DNA, 14 bp, Artificial Sequence
  Synthetic Oligonucleotide
cctcgaacccactg

SEQ ID NO: 608 - DNA, 16 bp, Artificial Sequence
  Synthetic Oligonucleotide
cttctggacctcgatc

SEQ ID NO: 609 - DNA, 14 bp, Artificial Sequence
  Synthetic Oligonucleotide
tctggacctcgatc

SEQ ID NO: 610 - DNA, 16 bp, Artificial Sequence
  Synthetic Oligonucleotide
ctgctatacatcttgg

SEQ ID NO: 611 - DNA, 14 bp, Artificial Sequence
  Synthetic Oligonucleotide
gctatacatcttgg

SEQ ID NO: 612 - DNA, 16 bp, Artificial Sequence
  Synthetic Oligonucleotide
cacggtgtacatcacc

SEQ ID NO: 613 - DNA, 14 bp, Artificial Sequence
  Synthetic Oligonucleotide
cggtgtacatcacc

SEQ ID NO: 614 - DNA, 16 bp, Artificial Sequence
  Synthetic Oligonucleotide
ggacagactgtagccc

SEQ ID NO: 615 - DNA, 14 bp, Artificial Sequence
  Synthetic Oligonucleotide
acagactgtagccc

SEQ ID NO: 616 - DNA, 16 bp, Artificial Sequence
  Synthetic Oligonucleotide
gtcatcgccaatcttc

SEQ ID NO: 617 - DNA, 14 bp, Artificial Sequence
  Synthetic Oligonucleotide
catcgccaatcttc

SEQ ID NO: 618 - DNA, 16 bp, Artificial Sequence
  Synthetic Oligonucleotide
tcacactgaggtcatc

SEQ ID NO: 619 - DNA, 14 bp, Artificial Sequence
  Synthetic Oligonucleotide
acactgaggtcatc

SEQ ID NO: 620 - DNA, 14 bp, Artificial Sequence
  Synthetic Oligonucleotide
cgccccgtcactga

SEQ ID NO: 621 - DNA, 16 bp, Artificial Sequence
  Synthetic Oligonucleotide
ccagcaaccagcaata

SEQ ID NO: 622 - DNA, 14 bp, Artificial Sequence
  Synthetic Oligonucleotide
agcaaccagcaata

SEQ ID NO: 623 - DNA, 16 bp, Artificial Sequence
  Synthetic Oligonucleotide
caggctgtacaggtac

SEQ ID NO: 624 - DNA, 14 bp, Artificial Sequence
  Synthetic Oligonucleotide
ggctgtacaggtac

SEQ ID NO: 625 - DNA, 16 bp, Artificial Sequence
  Synthetic Oligonucleotide
gaagctcctctcagag

SEQ ID NO: 626 - DNA, 14 bp, Artificial Sequence
  Synthetic Oligonucleotide
agctcctctcagag

SEQ ID NO: 627 - DNA, 16 bp, Artificial Sequence
  Synthetic Oligonucleotide
cccagccaatgcccag

SEQ ID NO: 628 - DNA, 14 bp, Artificial Sequence
  Synthetic Oligonucleotide
cagccaatgcccag

SEQ ID NO: 629 - DNA, 16 bp, Artificial Sequence
  Synthetic Oligonucleotide
tcaaacagacacttga

SEQ ID NO: 630 - DNA, 14 bp, Artificial Sequence
  Synthetic Oligonucleotide
aaacagacacttga

SEQ ID NO: 631 - DNA, 16 bp, Artificial Sequence
  Synthetic Oligonucleotide
agcactgaacattctc

SEQ ID NO: 632 - DNA, 14 bp, Artificial Sequence
  Synthetic Oligonucleotide
cactgaacattctc

SEQ ID NO: 633 - DNA, 16 bp, Artificial Sequence
  Synthetic Oligonucleotide
ggatccaccagaatcc

SEQ ID NO: 634 - DNA, 14 bp, Artificial Sequence
  Synthetic Oligonucleotide
atccaccagaatcc

SEQ ID NO: 635 - DNA, 14 bp, Artificial Sequence
  Synthetic Oligonucleotide
tgatcagtaaggcc

SEQ ID NO: 636 - DNA, 16 bp, Artificial Sequence
  Synthetic Oligonucleotide
ggacaaagatgaaaaa

SEQ ID NO: 637 - DNA, 14 bp, Artificial Sequence
  Synthetic Oligonucleotide
acaaagatgaaaaa

SEQ ID NO: 638 - DNA, 16 bp, Artificial Sequence
  Synthetic Oligonucleotide
ggcacgcagcttggcc

SEQ ID NO: 639 - DNA, 14 bp, Artificial Sequence
  Synthetic Oligonucleotide
cacgcagcttggcc

SEQ ID NO: 640 - DNA, 16 bp, Artificial Sequence
  Synthetic Oligonucleotide
tggacccccagcagag

SEQ ID NO: 641 - DNA, 14 bp, Artificial Sequence
  Synthetic Oligonucleotide
gacccccagcagag

SEQ ID NO: 642 - DNA, 14 bp, Artificial Sequence
  Synthetic Oligonucleotide
caaaggcaaagacc

SEQ ID NO: 643 - DNA, 14 bp, Artificial Sequence
  Synthetic Oligonucleotide
tcacaaaggcaaag

SEQ ID NO: 644 - DNA, 14 bp, Artificial Sequence
  Synthetic Oligonucleotide
cagtcacaaaggca

SEQ ID NO: 645 - DNA, 14 bp, Artificial Sequence
  Synthetic Oligonucleotide
cgtcagtcacaaag

SEQ ID NO: 646 - DNA, 14 bp, Artificial Sequence
  Synthetic Oligonucleotide
gctcgtcagtcaca

SEQ ID NO: 647 - DNA, 14 bp, Artificial Sequence
  Synthetic Oligonucleotide
catgctcgtcagtc

SEQ ID NO: 648 - DNA, 14 bp, Artificial Sequence
  Synthetic Oligonucleotide
gggcatgctcgtca

SEQ ID NO: 649-653 - skipped (5 entries)

SEQ ID NO: 654 - DNA, 14 bp, Artificial Sequence
  Synthetic Oligonucleotide
cttgggcatgctcg

SEQ ID NO: 655-656 - skipped (2 entries)

SEQ ID NO: 657 - DNA, 14 bp, Artificial Sequence
  Synthetic Oligonucleotide
tgccttgggcatgc

SEQ ID NO: 658 - DNA, 14 bp, Artificial Sequence
  Synthetic Oligonucleotide
gggtgccttgggca

SEQ ID NO: 659 - DNA, 14 bp, Artificial Sequence
  Synthetic Oligonucleotide
gcagggtgccttgg

SEQ ID NO: 660 - DNA, 14 bp, Artificial Sequence
  Synthetic Oligonucleotide
agcgcagggtgcct

SEQ ID NO: 661 - DNA, 16 bp, Artificial Sequence
  Synthetic Oligonucleotide
gtggagcgcagggtgc

SEQ ID NO: 662 - DNA, 14 bp, Artificial Sequence
  Synthetic Oligonucleotide
tggagcgcagggtg

SEQ ID NO: 663 - DNA, 14 bp, Artificial Sequence
  Synthetic Oligonucleotide
tggtggagcgcagg

SEQ ID NO: 664 - DNA, 14 bp, Artificial Sequence
  Synthetic Oligonucleotide
gcttggtggagcgc

SEQ ID NO: 665 - DNA, 14 bp, Artificial Sequence
  Synthetic Oligonucleotide
agagcttggtggag

SEQ ID NO: 666 - DNA, 16 bp, Artificial Sequence
  Synthetic Oligonucleotide
aaaagagcttggtgga

SEQ ID NO: 667 - DNA, 14 bp, Artificial Sequence
  Synthetic Oligonucleotide
aagagcttggtgga

SEQ ID NO: 668 - DNA, 14 bp, Artificial Sequence
  Synthetic Oligonucleotide
aaaagagcttggtg

SEQ ID NO: 669 - DNA, 14 bp, Artificial Sequence
  Synthetic Oligonucleotide
caaaaaagagcttg

SEQ ID NO: 670 - DNA, 16 bp, Artificial Sequence
  Synthetic Oligonucleotide
aaggagctgaggaaca

SEQ ID NO: 671 - DNA, 14 bp, Artificial Sequence
  Synthetic Oligonucleotide
ggagctgaggaaca

SEQ ID NO: 672 - DNA, 16 bp, Artificial Sequence
  Synthetic Oligonucleotide
gcagaccctggaagga

SEQ ID NO: 673 - DNA, 14 bp, Artificial Sequence
  Synthetic Oligonucleotide
agaccctggaagga

SEQ ID NO: 674 - DNA, 16 bp, Artificial Sequence
  Synthetic Oligonucleotide
accagcagaccctgga

SEQ ID NO: 675 - skipped

SEQ ID NO: 676 - DNA, 16 bp, Artificial Sequence
  Synthetic Oligonucleotide
cagtagagaacagcca

SEQ ID NO: 677 - DNA, 14 bp, Artificial Sequence
  Synthetic Oligonucleotide
gtagagaacagcca

SEQ ID NO: 678 - DNA, 16 bp, Artificial Sequence
  Synthetic Oligonucleotide
tgttgaggaaacagta

SEQ ID NO: 679 - DNA, 14 bp, Artificial Sequence
  Synthetic Oligonucleotide
ttgaggaaacagta

SEQ ID NO: 680 - DNA, 16 bp, Artificial Sequence
  Synthetic Oligonucleotide
cctgcacctccttgtt

SEQ ID NO: 681 - DNA, 14 bp, Artificial Sequence
  Synthetic Oligonucleotide
atgagggtcttcat

SEQ ID NO: 682 - DNA, 14 bp, Artificial Sequence
  Synthetic Oligonucleotide
accccggagtaggc

SEQ ID NO: 683 - DNA, 12 bp, Artificial Sequence
  Synthetic Oligonucleotide
cccggagtaggc

SEQ ID NO: 684 - DNA, 16 bp, Artificial Sequence
  Synthetic Oligonucleotide
caggaccccggagtag

SEQ ID NO: 685 - DNA, 16 bp, Artificial Sequence
  Synthetic Oligonucleotide
gcaggaccccggagta

SEQ ID NO: 686 - DNA, 14 bp, Artificial Sequence
  Synthetic Oligonucleotide
aggaccccggagta

SEQ ID NO: 687 - DNA, 14 bp, Artificial Sequence
  Synthetic Oligonucleotide
caggaccccggagt

SEQ ID NO: 688 - DNA, 12 bp, Artificial Sequence
  Synthetic Oligonucleotide
cagacccctcgc

SEQ ID NO: 689 - DNA, 12 bp, Artificial Sequence
  Synthetic Oligonucleotide
agaggatgctgg

SEQ ID NO: 690 - DNA, 16 bp, Artificial Sequence
  Synthetic Oligonucleotide
gagccaggtgacagag

SEQ ID NO: 691 - DNA, 14 bp, Artificial Sequence
  Synthetic Oligonucleotide
agccaggtgacaga

SEQ ID NO: 692 - DNA, 12 bp, Artificial Sequence
  Synthetic Oligonucleotide
tgagccaggtga

SEQ ID NO: 693 - DNA, 14 bp, Artificial Sequence
  Synthetic Oligonucleotide
ttttccaccttgga

SEQ ID NO: 694 - DNA, 12 bp, Artificial Sequence
  Synthetic Oligonucleotide
ctgcaggccact

SEQ ID NO: 695 - DNA, 16 bp, Artificial Sequence
  Synthetic Oligonucleotide
tcaccagctggatggg

SEQ ID NO: 696 - DNA, 16 bp, Artificial Sequence
  Synthetic Oligonucleotide
ttcaccagctggatgg

SEQ ID NO: 697 - DNA, 14 bp, Artificial Sequence
  Synthetic Oligonucleotide
caccagctggatgg

SEQ ID NO: 698 - DNA, 14 bp, Artificial Sequence
  Synthetic Oligonucleotide
tcaccagctggatg

SEQ ID NO: 699 - DNA, 12 bp, Artificial Sequence
  Synthetic Oligonucleotide
tcaccagctgga

SEQ ID NO: 700 - DNA, 16 bp, Artificial Sequence
  Synthetic Oligonucleotide
tgtcttcaccagctgg

SEQ ID NO: 701 - DNA, 14 bp, Artificial Sequence
  Synthetic Oligonucleotide
gtcttcaccagctg

SEQ ID NO: 702 - DNA, 16 bp, Artificial Sequence
  Synthetic Oligonucleotide
gtgtgtcttcaccagc

SEQ ID NO: 703 - DNA, 14 bp, Artificial Sequence
  Synthetic Oligonucleotide
tgtgtcttcaccag

SEQ ID NO: 704 - DNA, 16 bp, Artificial Sequence
  Synthetic Oligonucleotide
ttgtgtgtcttcacca

SEQ ID NO: 705 - DNA, 14 bp, Artificial Sequence
  Synthetic Oligonucleotide
tgtgtgtcttcacc

SEQ ID NO: 706 - DNA, 16 bp, Artificial Sequence
  Synthetic Oligonucleotide
aggttgtgtgtcttca

SEQ ID NO: 707 - DNA, 14 bp, Artificial Sequence
  Synthetic Oligonucleotide
ggttgtgtgtcttc

SEQ ID NO: 708 - DNA, 16 bp, Artificial Sequence
  Synthetic Oligonucleotide
gcaggttgtgtgtctt

SEQ ID NO: 709 - DNA, 14 bp, Artificial Sequence
  Synthetic Oligonucleotide
caggttgtgtgtct

SEQ ID NO: 710 - DNA, 16 bp, Artificial Sequence
  Synthetic Oligonucleotide
tcagcaggttgtgtgt

SEQ ID NO: 711 - DNA, 14 bp, Artificial Sequence
  Synthetic Oligonucleotide
cagcaggttgtgtg

SEQ ID NO: 712 - DNA, 16 bp, Artificial Sequence
  Synthetic Oligonucleotide
ggtcagcaggttgtgt

SEQ ID NO: 713 - DNA, 16 bp, Artificial Sequence
  Synthetic Oligonucleotide
tggtcagcaggttgtg

SEQ ID NO: 714 - DNA, 14 bp, Artificial Sequence
  Synthetic Oligonucleotide
gtcagcaggttgtg

SEQ ID NO: 715 - DNA, 14 bp, Artificial Sequence
  Synthetic Oligonucleotide
ggtcagcaggttgt

SEQ ID NO: 716 - DNA, 16 bp, Artificial Sequence
  Synthetic Oligonucleotide
ctggtggtcagcaggt

SEQ ID NO: 717 - DNA, 14 bp, Artificial Sequence
  Synthetic Oligonucleotide
tggtggtcagcagg

SEQ ID NO: 718 - DNA, 12 bp, Artificial Sequence
  Synthetic Oligonucleotide
ctggtggtcagc

SEQ ID NO: 719 - DNA, 16 bp, Artificial Sequence
  Synthetic Oligonucleotide
agttcctggtggtcag

SEQ ID NO: 720 - DNA, 14 bp, Artificial Sequence
  Synthetic Oligonucleotide
gttcctggtggtca

SEQ ID NO: 721 - DNA, 16 bp, Artificial Sequence
  Synthetic Oligonucleotide
tatagttcctggtggt

SEQ ID NO: 722 - DNA, 14 bp, Artificial Sequence
  Synthetic Oligonucleotide
atagttcctggtgg

SEQ ID NO: 723 - DNA, 16 bp, Artificial Sequence
  Synthetic Oligonucleotide
gatatagttcctggtg

SEQ ID NO: 724 - DNA, 14 bp, Artificial Sequence
  Synthetic Oligonucleotide
atatagttcctggt

SEQ ID NO: 725 - DNA, 16 bp, Artificial Sequence
  Synthetic Oligonucleotide
ccaaagatatagttcc

SEQ ID NO: 726 - DNA, 16 bp, Artificial Sequence
  Synthetic Oligonucleotide
tccaaagatatagttc

SEQ ID NO: 727 - DNA, 14 bp, Artificial Sequence
  Synthetic Oligonucleotide
caaagatatagttc

SEQ ID NO: 728 - DNA, 14 bp, Artificial Sequence
  Synthetic Oligonucleotide
ccaaagatatagtt

SEQ ID NO: 729 - DNA, 12 bp, Artificial Sequence
  Synthetic Oligonucleotide
ccaggcccatga

SEQ ID NO: 730 - DNA, 16 bp, Artificial Sequence
  Synthetic Oligonucleotide
ggcacccaggcccatg

SEQ ID NO: 731 - DNA, 14 bp, Artificial Sequence
  Synthetic Oligonucleotide
gcacccaggcccat

SEQ ID NO: 732 - DNA, 16 bp, Artificial Sequence
  Synthetic Oligonucleotide
cagaaggcacccaggc

SEQ ID NO: 733 - DNA, 14 bp, Artificial Sequence
  Synthetic Oligonucleotide
agaaggcacccagg

SEQ ID NO: 734 - DNA, 12 bp, Artificial Sequence
  Synthetic Oligonucleotide
ccagacatcagg

SEQ ID NO: 735 - DNA, 12 bp, Artificial Sequence
  Synthetic Oligonucleotide
gacagggcagat

SEQ ID NO: 736 - DNA, 12 bp, Artificial Sequence
  Synthetic Oligonucleotide
tgacagggcaga

SEQ ID NO: 737 - DNA, 12 bp, Artificial Sequence
  Synthetic Oligonucleotide
ccactcccattc

SEQ ID NO: 738 - DNA, 16 bp, Artificial Sequence
  Synthetic Oligonucleotide
gccaggcatggagctc

SEQ ID NO: 739 - DNA, 14 bp, Artificial Sequence
  Synthetic Oligonucleotide
ccaggcatggagct

SEQ ID NO: 740 - DNA, 12 bp, Artificial Sequence
  Synthetic Oligonucleotide
ccaggcatggag

SEQ ID NO: 741 - DNA, 12 bp, Artificial Sequence
  Synthetic Oligonucleotide
cagggtgactgc

SEQ ID NO: 742 - DNA, 16 bp, Artificial Sequence
  Synthetic Oligonucleotide
gttccgcagggtgact

SEQ ID NO: 743 - DNA, 14 bp, Artificial Sequence
  Synthetic Oligonucleotide
ttccgcagggtgac

SEQ ID NO: 744 - DNA, 16 bp, Artificial Sequence
  Synthetic Oligonucleotide
gcggttccgcagggtg

SEQ ID NO: 745 - DNA, 14 bp, Artificial Sequence
  Synthetic Oligonucleotide
cggttccgcagggt

SEQ ID NO: 746 - DNA, 16 bp, Artificial Sequence
  Synthetic Oligonucleotide
tcggccccaggagccc

SEQ ID NO: 747 - DNA, 14 bp, Artificial Sequence
  Synthetic Oligonucleotide
cggccccaggagcc

SEQ ID NO: 748 - DNA, 16 bp, Artificial Sequence
  Synthetic Oligonucleotide
ccatcggccccaggag

SEQ ID NO: 749 - DNA, 14 bp, Artificial Sequence
  Synthetic Oligonucleotide
catcggccccagga

SEQ ID NO: 750 - DNA, 16 bp, Artificial Sequence
  Synthetic Oligonucleotide
gacccatcggccccag

SEQ ID NO: 751 - DNA, 14 bp, Artificial Sequence
  Synthetic Oligonucleotide
acccatcggcccca

SEQ ID NO: 752 - DNA, 16 bp, Artificial Sequence
  Synthetic Oligonucleotide
ttctggacccatcggc

SEQ ID NO: 753 - DNA, 12 bp, Artificial Sequence
  Synthetic Oligonucleotide
ggacccatcggc

SEQ ID NO: 754 - DNA, 14 bp, Artificial Sequence
  Synthetic Oligonucleotide
tctggacccatcgg

SEQ ID NO: 755 - DNA, 16 bp, Artificial Sequence
  Synthetic Oligonucleotide
caccagcccccaggtg

SEQ ID NO: 756 - DNA, 14 bp, Artificial Sequence
  Synthetic Oligonucleotide
accagcccccaggt

SEQ ID NO: 757 - DNA, 16 bp, Artificial Sequence
  Synthetic Oligonucleotide
tagggcaccagccccc

SEQ ID NO: 758 - DNA, 14 bp, Artificial Sequence
  Synthetic Oligonucleotide
agggcaccagcccc

SEQ ID NO: 759 - DNA, 16 bp, Artificial Sequence
  Synthetic Oligonucleotide
tggagtagggcaccag

SEQ ID NO: 760 - DNA, 14 bp, Artificial Sequence
  Synthetic Oligonucleotide
ggagtagggcacca

SEQ ID NO: 761 - DNA, 12 bp, Artificial Sequence
  Synthetic Oligonucleotide
cttggagtaggg

SEQ ID NO: 762 - DNA, 16 bp, Artificial Sequence
  Synthetic Oligonucleotide
tgatgggcttggagta

SEQ ID NO: 763 - DNA, 14 bp, Artificial Sequence
  Synthetic Oligonucleotide
gatgggcttggagt

SEQ ID NO: 764 - DNA, 16 bp, Artificial Sequence
  Synthetic Oligonucleotide
tgtggtacaggtcgat

SEQ ID NO: 765 - DNA, 14 bp, Artificial Sequence
  Synthetic Oligonucleotide
gtggtacaggtcga

SEQ ID NO: 766 - DNA, 12 bp, Artificial Sequence
  Synthetic Oligonucleotide
ggtacaggtcga

SEQ ID NO: 767 - DNA, 16 bp, Artificial Sequence
  Synthetic Oligonucleotide
ggtgtggtacaggtcg

SEQ ID NO: 768 - DNA, 14 bp, Artificial Sequence
  Synthetic Oligonucleotide
gtgtggtacaggtc

SEQ ID NO: 769 - DNA, 16 bp, Artificial Sequence
  Synthetic Oligonucleotide
catggtgtggtacagg

SEQ ID NO: 770 - DNA, 14 bp, Artificial Sequence
  Synthetic Oligonucleotide
atggtgtggtacag

SEQ ID NO: 771 - DNA, 16 bp, Artificial Sequence
  Synthetic Oligonucleotide
tacatggtgtggtaca

SEQ ID NO: 772 - DNA, 14 bp, Artificial Sequence
  Synthetic Oligonucleotide
acatggtgtggtac

SEQ ID NO: 773 - DNA, 16 bp, Artificial Sequence
  Synthetic Oligonucleotide
atgtacatggtgtggt

SEQ ID NO: 774 - DNA, 14 bp, Artificial Sequence
  Synthetic Oligonucleotide
tgtacatggtgtgg

SEQ ID NO: 775 - DNA, 12 bp, Artificial Sequence
  Synthetic Oligonucleotide
gcctccatgtac

SEQ ID NO: 776 - DNA, 12 bp, Artificial Sequence
  Synthetic Oligonucleotide
agcttcaccagg

SEQ ID NO: 777 - DNA, 12 bp, Artificial Sequence
  Synthetic Oligonucleotide
gttcacctccag

SEQ ID NO: 778 - DNA, 16 bp, Artificial Sequence
  Synthetic Oligonucleotide
catgccccagccgccg

SEQ ID NO: 779 - DNA, 14 bp, Artificial Sequence
  Synthetic Oligonucleotide
atgccccagccgcc

SEQ ID NO: 780 - DNA, 16 bp, Artificial Sequence
  Synthetic Oligonucleotide
gatgagggtcttcatg

SEQ ID NO: 781 - DNA, 16 bp, Artificial Sequence
  Synthetic Oligonucleotide
gaccccggagtaggca

SEQ ID NO: 782 - DNA, 16 bp, Artificial Sequence
  Synthetic Oligonucleotide
atgctggagccagtgc

SEQ ID NO: 783 - DNA, 14 bp, Artificial Sequence
  Synthetic Oligonucleotide
tgctggagccagtg

SEQ ID NO: 784 - DNA, 14 bp, Artificial Sequence
  Synthetic Oligonucleotide
gtcttggagggccg

SEQ ID NO: 785 - DNA, 14 bp, Artificial Sequence
  Synthetic Oligonucleotide
cccaggtgtcagag

SEQ ID NO: 786 - DNA, 16 bp, Artificial Sequence
  Synthetic Oligonucleotide
ttttccaccttggatc

SEQ ID NO: 787 - DNA, 14 bp, Artificial Sequence
  Synthetic Oligonucleotide
tttccaccttggat

SEQ ID NO: 788 - DNA, 16 bp, Artificial Sequence
  Synthetic Oligonucleotide
tttttccaccttggat

SEQ ID NO: 789 - DNA, 16 bp, Artificial Sequence
  Synthetic Oligonucleotide
aggtgtttttccacct

SEQ ID NO: 790 - DNA, 14 bp, Artificial Sequence
  Synthetic Oligonucleotide
ggtgtttttccacc

SEQ ID NO: 791 - DNA, 16 bp, Artificial Sequence
  Synthetic Oligonucleotide
ccaggaaggataggac

SEQ ID NO: 792 - DNA, 14 bp, Artificial Sequence
  Synthetic Oligonucleotide
caggaaggatagga

SEQ ID NO: 793 - DNA, 16 bp, Artificial Sequence
  Synthetic Oligonucleotide
tgacactgcaggccac

SEQ ID NO: 794 - DNA, 14 bp, Artificial Sequence
  Synthetic Oligonucleotide
gacactgcaggcca

SEQ ID NO: 795 - DNA, 16 bp, Artificial Sequence
  Synthetic Oligonucleotide
acatgaggatgacact

SEQ ID NO: 796 - DNA, 14 bp, Artificial Sequence
  Synthetic Oligonucleotide
catgaggatgacac

SEQ ID NO: 797 - DNA, 16 bp, Artificial Sequence
  Synthetic Oligonucleotide
gcagaaggtgtacatg

SEQ ID NO: 798 - DNA, 14 bp, Artificial Sequence
  Synthetic Oligonucleotide
cagaaggtgtacat

SEQ ID NO: 799 - DNA, 16 bp, Artificial Sequence
  Synthetic Oligonucleotide
gcagtcagtgcagaag

SEQ ID NO: 800 - DNA, 14 bp, Artificial Sequence
  Synthetic Oligonucleotide
cagtcagtgcagaa

SEQ ID NO: 801 - DNA, 16 bp, Artificial Sequence
  Synthetic Oligonucleotide
acacggcccagtttcg

SEQ ID NO: 802 - DNA, 14 bp, Artificial Sequence
  Synthetic Oligonucleotide
cacggcccagtttc

SEQ ID NO: 803 - DNA, 16 bp, Artificial Sequence
  Synthetic Oligonucleotide
ggcccatgatgccatg

SEQ ID NO: 804 - DNA, 14 bp, Artificial Sequence
  Synthetic Oligonucleotide
gcccatgatgccat

SEQ ID NO: 805 - DNA, 16 bp, Artificial Sequence
  Synthetic Oligonucleotide
tacagaaggcacccag

SEQ ID NO: 806 - DNA, 14 bp, Artificial Sequence
  Synthetic Oligonucleotide
acagaaggcaccca

SEQ ID NO: 807 - DNA, 16 bp, Artificial Sequence
  Synthetic Oligonucleotide
gaagttgccagccaat

SEQ ID NO: 808 - DNA, 14 bp, Artificial Sequence
  Synthetic Oligonucleotide
aagttgccagccaa

SEQ ID NO: 809 - DNA, 14 bp, Artificial Sequence
  Synthetic Oligonucleotide
cagggcagatcctt

SEQ ID NO: 810 - DNA, 16 bp, Artificial Sequence
  Synthetic Oligonucleotide
caagtagtctatggtg

SEQ ID NO: 811 - DNA, 14 bp, Artificial Sequence
  Synthetic Oligonucleotide
aagtagtctatggt

SEQ ID NO: 812 - DNA, 16 bp, Artificial Sequence
  Synthetic Oligonucleotide
tggaaagcaagtagtc

SEQ ID NO: 813 - DNA, 14 bp, Artificial Sequence
  Synthetic Oligonucleotide
ggaaagcaagtagt

SEQ ID NO: 814 - DNA, 16 bp, Artificial Sequence
  Synthetic Oligonucleotide
ggccagctttacaaag

SEQ ID NO: 815 - DNA, 14 bp, Artificial Sequence
  Synthetic Oligonucleotide
gccagctttacaaa

SEQ ID NO: 816 - DNA, 14 bp, Artificial Sequence
  Synthetic Oligonucleotide
cgcagggccagctt

SEQ ID NO: 817 - DNA, 16 bp, Artificial Sequence
  Synthetic Oligonucleotide
aaaggaataggtggga

SEQ ID NO: 818 - DNA, 14 bp, Artificial Sequence
  Synthetic Oligonucleotide
aaggaataggtggg

SEQ ID NO: 819 - DNA, 16 bp, Artificial Sequence
  Synthetic Oligonucleotide
gcgaaaccaatatact

SEQ ID NO: 820 - DNA, 14 bp, Artificial Sequence
  Synthetic Oligonucleotide
cgaaaccaatatac

SEQ ID NO: 821 - DNA, 16 bp, Artificial Sequence
  Synthetic Oligonucleotide
ccccaggtgtcagagg

SEQ ID NO: 822 - skipped

SEQ ID NO: 823 - DNA, 16 bp, Artificial Sequence
  Synthetic Oligonucleotide
gattgtcaaagagctt

SEQ ID NO: 824 - DNA, 14 bp, Artificial Sequence
  Synthetic Oligonucleotide
attgtcaaagagct

SEQ ID NO: 825 - DNA, 16 bp, Artificial Sequence
  Synthetic Oligonucleotide
ttggtcttgtgattgt

SEQ ID NO: 826 - DNA, 14 bp, Artificial Sequence
  Synthetic Oligonucleotide
tggtcttgtgattg

SEQ ID NO: 827 - DNA, 16 bp, Artificial Sequence
  Synthetic Oligonucleotide
aaggccgaatttggtc

SEQ ID NO: 828 - DNA, 14 bp, Artificial Sequence
  Synthetic Oligonucleotide
aggccgaatttggt

SEQ ID NO: 829 - DNA, 12 bp, Artificial Sequence
  Synthetic Oligonucleotide
aatccgactgtg

SEQ ID NO: 830 - DNA, 12 bp, Artificial Sequence
  Synthetic Oligonucleotide
aatttaatccga

SEQ ID NO: 831 - DNA, 14 bp, Artificial Sequence
  Synthetic Oligonucleotide
accttcgatcacag

SEQ ID NO: 832 - DNA, 12 bp, Artificial Sequence
  Synthetic Oligonucleotide
actgatcctgca

SEQ ID NO: 833 - DNA, 12 bp, Artificial Sequence
  Synthetic Oligonucleotide
actgtggtcaaa

SEQ ID NO: 834 - DNA, 12 bp, Artificial Sequence
  Synthetic Oligonucleotide
agccgcccagtt

SEQ ID NO: 835 - DNA, 12 bp, Artificial Sequence
  Synthetic Oligonucleotide
agccttgtcgat

SEQ ID NO: 836 - DNA, 12 bp, Artificial Sequence
  Synthetic Oligonucleotide
agttcccagcct

SEQ ID NO: 837 - DNA, 12 bp, Artificial Sequence
  Synthetic Oligonucleotide
atccgactgtgg

SEQ ID NO: 838 - DNA, 12 bp, Artificial Sequence
  Synthetic Oligonucleotide
atcctgcactga

SEQ ID NO: 839 - DNA, 12 bp, Artificial Sequence
  Synthetic Oligonucleotide
atttaatccgac

SEQ ID NO: 840 - DNA, 12 bp, Artificial Sequence
  Synthetic Oligonucleotide
caatttaatccg

SEQ ID NO: 841 - DNA, 12 bp, Artificial Sequence
  Synthetic Oligonucleotide
cactgacgagtc

SEQ ID NO: 842 - DNA, 12 bp, Artificial Sequence
  Synthetic Oligonucleotide
cactgatcctgc

SEQ ID NO: 843 - DNA, 12 bp, Artificial Sequence
  Synthetic Oligonucleotide
cagccttgtcga

SEQ ID NO: 844 - DNA, 12 bp, Artificial Sequence
  Synthetic Oligonucleotide
cagttcccagcc

SEQ ID NO: 845 - DNA, 12 bp, Artificial Sequence
  Synthetic Oligonucleotide
ccactgatcctg

SEQ ID NO: 846 - DNA, 12 bp, Artificial Sequence
  Synthetic Oligonucleotide
ccagccttgtcg

SEQ ID NO: 847 - DNA, 12 bp, Artificial Sequence
  Synthetic Oligonucleotide
ccagttcccagc

SEQ ID NO: 848 - DNA, 12 bp, Artificial Sequence
  Synthetic Oligonucleotide
cccagccttgtc

SEQ ID NO: 849 - DNA, 12 bp, Artificial Sequence
  Synthetic Oligonucleotide
cccagttcccag

SEQ ID NO: 850 - DNA, 12 bp, Artificial Sequence
  Synthetic Oligonucleotide
ccgcccagttcc

SEQ ID NO: 851 - DNA, 12 bp, Artificial Sequence
  Synthetic Oligonucleotide
cctgcactgacg

SEQ ID NO: 852 - DNA, 14 bp, Artificial Sequence
  Synthetic Oligonucleotide
ccttggaatgtctg

SEQ ID NO: 853 - DNA, 12 bp, Artificial Sequence
  Synthetic Oligonucleotide
ccttgtcgatct

SEQ ID NO: 854 - DNA, 12 bp, Artificial Sequence
  Synthetic Oligonucleotide
cgactgtggtca

SEQ ID NO: 855 - DNA, 12 bp, Artificial Sequence
  Synthetic Oligonucleotide
cgcccagttccc

SEQ ID NO: 856 - DNA, 12 bp, Artificial Sequence
  Synthetic Oligonucleotide
ctgatcctgcac

SEQ ID NO: 857 - DNA, 12 bp, Artificial Sequence
  Synthetic Oligonucleotide
ctgcactgacga

SEQ ID NO: 858 - DNA, 12 bp, Artificial Sequence
  Synthetic Oligonucleotide
ctgtggtcaaaa

SEQ ID NO: 859 - DNA, 12 bp, Artificial Sequence
  Synthetic Oligonucleotide
cttgtcgatctc

SEQ ID NO: 860 - DNA, 12 bp, Artificial Sequence
  Synthetic Oligonucleotide
gatcctgcactg

SEQ ID NO: 861 - DNA, 12 bp, Artificial Sequence
  Synthetic Oligonucleotide
gcaatttaatcc

SEQ ID NO: 862 - DNA, 12 bp, Artificial Sequence
  Synthetic Oligonucleotide
gcactgacgagt

SEQ ID NO: 863 - DNA, 12 bp, Artificial Sequence
  Synthetic Oligonucleotide
gcccagttccca

SEQ ID NO: 864 - DNA, 12 bp, Artificial Sequence
  Synthetic Oligonucleotide
gccgcccagttc

SEQ ID NO: 865 - DNA, 12 bp, Artificial Sequence
  Synthetic Oligonucleotide
gccttgtcgatc

SEQ ID NO: 866 - DNA, 12 bp, Artificial Sequence
  Synthetic Oligonucleotide
ggtcaaaagggc

SEQ ID NO: 867 - DNA, 14 bp, Artificial Sequence
  Synthetic Oligonucleotide
ggtcatgcacaggc

SEQ ID NO: 868 - DNA, 12 bp, Artificial Sequence
  Synthetic Oligonucleotide
gtcgatctcctc

SEQ ID NO: 869 - DNA, 12 bp, Artificial Sequence
  Synthetic Oligonucleotide
gtggtcaaaagg

SEQ ID NO: 870 - DNA, 12 bp, Artificial Sequence
  Synthetic Oligonucleotide
gttcccagcctt

SEQ ID NO: 871 - DNA, 12 bp, Artificial Sequence
  Synthetic Oligonucleotide
taatccgactgt

SEQ ID NO: 872 - DNA, 14 bp, Artificial Sequence
  Synthetic Oligonucleotide
tattccatggccat

SEQ ID NO: 873 - DNA, 14 bp, Artificial Sequence
  Synthetic Oligonucleotide
tcaggtcatgcaca

SEQ ID NO: 874 - DNA, 12 bp, Artificial Sequence
  Synthetic Oligonucleotide
tcccagccttgt

SEQ ID NO: 875 - DNA, 12 bp, Artificial Sequence
  Synthetic Oligonucleotide
tccgactgtggt

SEQ ID NO: 876 - DNA, 12 bp, Artificial Sequence
  Synthetic Oligonucleotide
tcctgcactgac

SEQ ID NO: 877 - DNA, 12 bp, Artificial Sequence
  Synthetic Oligonucleotide
tcgatctcctcg

SEQ ID NO: 878 - DNA, 12 bp, Artificial Sequence
  Synthetic Oligonucleotide
tgatcctgcact

SEQ ID NO: 879 - DNA, 12 bp, Artificial Sequence
  Synthetic Oligonucleotide
tgcaatttaatc

SEQ ID NO: 880 - DNA, 12 bp, Artificial Sequence
  Synthetic Oligonucleotide
tgcactgacgag

SEQ ID NO: 881 - DNA, 12 bp, Artificial Sequence
  Synthetic Oligonucleotide
tggtcaaaaggg

SEQ ID NO: 882 - DNA, 12 bp, Artificial Sequence
  Synthetic Oligonucleotide
tgtcgatctcct

SEQ ID NO: 883 - DNA, 12 bp, Artificial Sequence
  Synthetic Oligonucleotide
tgtggtcaaaag

SEQ ID NO: 884 - DNA, 12 bp, Artificial Sequence
  Synthetic Oligonucleotide
ttaatccgactg

SEQ ID NO: 885 - DNA, 12 bp, Artificial Sequence
  Synthetic Oligonucleotide
ttcccagccttg

SEQ ID NO: 886 - DNA, 12 bp, Artificial Sequence
  Synthetic Oligonucleotide
ttgtcgatctcc

SEQ ID NO: 887 - DNA, 12 bp, Artificial Sequence
  Synthetic Oligonucleotide
tttaatccgact

SEQ ID NO: 888 - DNA, 12 bp, Artificial Sequence
  Synthetic Oligonucleotide
gactgtggtcaa

SEQ ID NO: 889 - DNA, 12 bp, Artificial Sequence
  Synthetic Oligonucleotide
ccgactgtggtc

SEQ ID NO: 890 - DNA, 14 bp, Artificial Sequence
  Synthetic Oligonucleotide
cccagtgggtttga

SEQ ID NO: 891 - DNA, 12 bp, Artificial Sequence
  Synthetic Oligonucleotide
ttcttgatgtcc

SEQ ID NO: 892 - DNA, 12 bp, Artificial Sequence
  Synthetic Oligonucleotide
gactccaaagtc

SEQ ID NO: 893 - DNA, 16 bp, Artificial Sequence
  Synthetic Oligonucleotide
tcctgcactgacgagt

SEQ ID NO: 894 - DNA, 16 bp, Artificial Sequence
  Synthetic Oligonucleotide
cactgatcctgcactg

SEQ ID NO: 895 - DNA, 16 bp, Artificial Sequence
  Synthetic Oligonucleotide
cttccactgatcctta

SEQ ID NO: 896 - DNA, 16 bp, Artificial Sequence
  Synthetic Oligonucleotide
gaaagctccttccact

SEQ ID NO: 897 - DNA, 14 bp, Artificial Sequence
  Synthetic Oligonucleotide
ggcagtctttatcc

SEQ ID NO: 898 - DNA, 12 bp, Artificial Sequence
  Synthetic Oligonucleotide
ctggtaaatagc

SEQ ID NO: 899 - DNA, 14 bp, Artificial Sequence
  Synthetic Oligonucleotide
ctacctgaggattt

SEQ ID NO: 900 - DNA, 14 bp, Artificial Sequence
  Synthetic Oligonucleotide
cccagtactacctg

SEQ ID NO: 901 - DNA, 12 bp, Artificial Sequence
  Synthetic Oligonucleotide
tgttccctctac

SEQ ID NO: 902 - DNA, 14 bp, Artificial Sequence
  Synthetic Oligonucleotide
tattcctggaaaac

SEQ ID NO: 903 - DNA, 14 bp, Artificial Sequence
  Synthetic Oligonucleotide
caagaagtgtggtt

SEQ ID NO: 904 - DNA, 14 bp, Artificial Sequence
  Synthetic Oligonucleotide
gtgaaaatgctggc

SEQ ID NO: 905 - DNA, 14 bp, Artificial Sequence
  Synthetic Oligonucleotide
aggaggttaaacca

SEQ ID NO: 906 - DNA, 12 bp, Artificial Sequence
  Synthetic Oligonucleotide
tggatgattggc

SEQ ID NO: 907 - DNA, 12 bp, Artificial Sequence
  Synthetic Oligonucleotide
caaaaggatccc

SEQ ID NO: 908 - DNA, 12 bp, Artificial Sequence
  Synthetic Oligonucleotide
atgtcaaccggc

SEQ ID NO: 909 - DNA, 12 bp, Artificial Sequence
  Synthetic Oligonucleotide
tcagccagacag

SEQ ID NO: 910 - DNA, 14 bp, Artificial Sequence
  Synthetic Oligonucleotide
taagtgtccctttg

SEQ ID NO: 911 - DNA, 14 bp, Artificial Sequence
  Synthetic Oligonucleotide
ctaaatttagttca

SEQ ID NO: 912 - DNA, 14 bp, Artificial Sequence
  Synthetic Oligonucleotide
gactacattttaca

SEQ ID NO: 913 - DNA, 14 bp, Artificial Sequence
  Synthetic Oligonucleotide
cagtaaggaatttt

SEQ ID NO: 914 - DNA, 14 bp, Artificial Sequence
  Synthetic Oligonucleotide
tgtgtccctcagtc

SEQ ID NO: 915 - DNA, 12 bp, Artificial Sequence
  Synthetic Oligonucleotide
ccgttggacccc

SEQ ID NO: 916 - DNA, 14 bp, Artificial Sequence
  Synthetic Oligonucleotide
gacagcttctataa

SEQ ID NO: 917 - DNA, 14 bp, Artificial Sequence
  Synthetic Oligonucleotide
agtgactgaccaca

SEQ ID NO: 918 - DNA, 14 bp, Artificial Sequence
  Synthetic Oligonucleotide
gtagcatagagcct

SEQ ID NO: 919 - DNA, 14 bp, Artificial Sequence
  Synthetic Oligonucleotide
cagatcttgtcaag

SEQ ID NO: 920 - DNA, 12 bp, Artificial Sequence
  Synthetic Oligonucleotide
gtaagaggcagg

SEQ ID NO: 921 - DNA, 12 bp, Artificial Sequence
  Synthetic Oligonucleotide
ccatggcgggac

SEQ ID NO: 922 - DNA, 12 bp, Artificial Sequence
  Synthetic Oligonucleotide
gcttacgattgt

SEQ ID NO: 923 - DNA, 14 bp, Artificial Sequence
  Synthetic Oligonucleotide
ccagcacactggaa

SEQ ID NO: 924 - DNA, 14 bp, Artificial Sequence
  Synthetic Oligonucleotide
gtcagtcccagcta

SEQ ID NO: 925 - DNA, 14 bp, Artificial Sequence
  Synthetic Oligonucleotide
ttagtatgacagct

SEQ ID NO: 926 - DNA, 14 bp, Artificial Sequence
  Synthetic Oligonucleotide
tcagtgtaggaaga

SEQ ID NO: 927 - DNA, 14 bp, Artificial Sequence
  Synthetic Oligonucleotide
tgaatatacagatg

SEQ ID NO: 928 - DNA, 12 bp, Artificial Sequence
  Synthetic Oligonucleotide
cccgccaccacc

SEQ ID NO: 929 - DNA, 12 bp, Artificial Sequence
  Synthetic Oligonucleotide
ttgttccctcta

SEQ ID NO: 930 - DNA, 14 bp, Artificial Sequence
  Synthetic Oligonucleotide
tctacctgagtcca

SEQ ID NO: 931 - DNA, 14 bp, Artificial Sequence
  Synthetic Oligonucleotide
aacatcaagcttga

SEQ ID NO: 932 - DNA, 14 bp, Artificial Sequence
  Synthetic Oligonucleotide
gatcaccttcagag

SEQ ID NO: 933 - DNA, 14 bp, Artificial Sequence
  Synthetic Oligonucleotide
tgaacacatcacta

SEQ ID NO: 934 - DNA, 12 bp, Artificial Sequence
  Synthetic Oligonucleotide
tttcctcttgtc

SEQ ID NO: 935 - DNA, 14 bp, Artificial Sequence
  Synthetic Oligonucleotide
taattgatgtcaat

SEQ ID NO: 936 - DNA, 14 bp, Artificial Sequence
  Synthetic Oligonucleotide
agtaattgatgtca

SEQ ID NO: 937 - DNA, 14 bp, Artificial Sequence
  Synthetic Oligonucleotide
acagtaattgatgt

SEQ ID NO: 938 - DNA, 14 bp, Artificial Sequence
  Synthetic Oligonucleotide
ttacagtaattgat

SEQ ID NO: 939 - DNA, 14 bp, Artificial Sequence
  Synthetic Oligonucleotide
acttacagtaattg

SEQ ID NO: 940 - DNA, 14 bp, Artificial Sequence
  Synthetic Oligonucleotide
agacttacagtaat

SEQ ID NO: 941 - DNA, 14 bp, Artificial Sequence
  Synthetic Oligonucleotide
tcagacttacagta

SEQ ID NO: 942 - DNA, 14 bp, Artificial Sequence
  Synthetic Oligonucleotide
aatcagacttacag

SEQ ID NO: 943 - DNA, 14 bp, Artificial Sequence
  Synthetic Oligonucleotide
tgaatcagacttac

SEQ ID NO: 944 - DNA, 14 bp, Artificial Sequence
  Synthetic Oligonucleotide
aatgaatcagactt

SEQ ID NO: 945 - DNA, 14 bp, Artificial Sequence
  Synthetic Oligonucleotide
tgcaggatgttgag

SEQ ID NO: 946 - DNA, 14 bp, Artificial Sequence
  Synthetic Oligonucleotide
ctggtcagcattga

SEQ ID NO: 947 - DNA, 14 bp, Artificial Sequence
  Synthetic Oligonucleotide
caaagtcccttagc

SEQ ID NO: 948 - DNA, 14 bp, Artificial Sequence
  Synthetic Oligonucleotide
atttctcttacagg

SEQ ID NO: 949 - DNA, 12 bp, Artificial Sequence
  Synthetic Oligonucleotide
ttaacgagcctt

SEQ ID NO: 950 - DNA, 12 bp, Artificial Sequence
  Synthetic Oligonucleotide
cgacacgggaac

SEQ ID NO: 951 - DNA, 12 bp, Artificial Sequence
  Synthetic Oligonucleotide
caagtaggatgt

SEQ ID NO: 952 - DNA, 14 bp, Artificial Sequence
  Synthetic Oligonucleotide
gttccctttgcagg

SEQ ID NO: 953 - DNA, 14 bp, Artificial Sequence
  Synthetic Oligonucleotide
attagccatatctc

SEQ ID NO: 954 - DNA, 14 bp, Artificial Sequence
  Synthetic Oligonucleotide
agcattcagcagtg

SEQ ID NO: 955 - DNA, 12 bp, Artificial Sequence
  Synthetic Oligonucleotide
ttccctctacac

SEQ ID NO: 956 - DNA, 12 bp, Artificial Sequence
  Synthetic Oligonucleotide
tccctctacacc

SEQ ID NO: 957 - DNA, 14 bp, Artificial Sequence
  Synthetic Oligonucleotide
ctacaggacaatac

SEQ ID NO: 958 - DNA, 14 bp, Artificial Sequence
  Synthetic Oligonucleotide
aactgggttaagta

SEQ ID NO: 959 - DNA, 14 bp, Artificial Sequence
  Synthetic Oligonucleotide
tgaacacgctatcc

SEQ ID NO: 960 - DNA, 14 bp, Artificial Sequence
  Synthetic Oligonucleotide
tttccacttgggtg

SEQ ID NO: 961 - DNA, 12 bp, Artificial Sequence
  Synthetic Oligonucleotide
tctacaccaggt

SEQ ID NO: 962 - DNA, 14 bp, Artificial Sequence
  Synthetic Oligonucleotide
gaaagctccttcca

SEQ ID NO: 963 - DNA, 12 bp, Artificial Sequence
  Synthetic Oligonucleotide
aggtaggagaag

SEQ ID NO: 964 - DNA, 12 bp, Artificial Sequence
  Synthetic Oligonucleotide
acccagtcaggg

SEQ ID NO: 965 - DNA, 12 bp, Artificial Sequence
  Synthetic Oligonucleotide
atgtcattaaac

SEQ ID NO: 966 - DNA, 12 bp, Artificial Sequence
  Synthetic Oligonucleotide
gaggtgggaaaa

SEQ ID NO: 967 - DNA, 14 bp, Artificial Sequence
  Synthetic Oligonucleotide
tttcctaggaggtg

SEQ ID NO: 968 - DNA, 12 bp, Artificial Sequence
  Synthetic Oligonucleotide
gttcttaggaag

SEQ ID NO: 969 - DNA, 12 bp, Artificial Sequence
  Synthetic Oligonucleotide
ctctacaccagg

SEQ ID NO: 970 - DNA, 14 bp, Artificial Sequence
  Synthetic Oligonucleotide
tgtttttacacaga

SEQ ID NO: 971 - DNA, 12 bp, Artificial Sequence
  Synthetic Oligonucleotide
tggcttcatgtc

SEQ ID NO: 972 - DNA, 14 bp, Artificial Sequence
  Synthetic Oligonucleotide
ttgttcttaggaag

SEQ ID NO: 973 - DNA, 12 bp, Artificial Sequence
  Synthetic Oligonucleotide
tacaccaggtca

SEQ ID NO: 974 - DNA, 14 bp, Artificial Sequence
  Synthetic Oligonucleotide
tgagctacagtagg

SEQ ID NO: 975 - DNA, 12 bp, Artificial Sequence
  Synthetic Oligonucleotide
ggctgacattca

SEQ ID NO: 976 - DNA, 14 bp, Artificial Sequence
  Synthetic Oligonucleotide
tggtcaactgaaag

SEQ ID NO: 977 - DNA, 12 bp, Artificial Sequence
  Synthetic Oligonucleotide
tagtcattatct

SEQ ID NO: 978 - DNA, 12 bp, Artificial Sequence
  Synthetic Oligonucleotide
ccatttttatca

SEQ ID NO: 979 - DNA, 14 bp, Artificial Sequence
  Synthetic Oligonucleotide
gggcttcttccatt

SEQ ID NO: 980 - DNA, 14 bp, Artificial Sequence
  Synthetic Oligonucleotide
ggtgtggataacag

SEQ ID NO: 981 - DNA, 14 bp, Artificial Sequence
  Synthetic Oligonucleotide
tcataactattaag

SEQ ID NO: 982 - DNA, 12 bp, Artificial Sequence
  Synthetic Oligonucleotide
cctctacaccag

SEQ ID NO: 983 - DNA, 14 bp, Artificial Sequence
  Synthetic Oligonucleotide
cagcttaggcagag

SEQ ID NO: 984 - DNA, 12 bp, Artificial Sequence
  Synthetic Oligonucleotide
tcattccccact

SEQ ID NO: 985 - DNA, 12 bp, Artificial Sequence
  Synthetic Oligonucleotide
ctcccacaccat

SEQ ID NO: 986 - DNA, 12 bp, Artificial Sequence
  Synthetic Oligonucleotide
ttctgctcccac

SEQ ID NO: 987 - DNA, 12 bp, Artificial Sequence
  Synthetic Oligonucleotide
cagagaaggtct

SEQ ID NO: 988 - DNA, 12 bp, Artificial Sequence
  Synthetic Oligonucleotide
gtatgcactgct

SEQ ID NO: 989 - DNA, 14 bp, Artificial Sequence
  Synthetic Oligonucleotide
caatgaagcacagg

SEQ ID NO: 990 - DNA, 12 bp, Artificial Sequence
  Synthetic Oligonucleotide
tcccaaacaaat

SEQ ID NO: 991 - DNA, 14 bp, Artificial Sequence
  Synthetic Oligonucleotide
attcttaacacaga

SEQ ID NO: 992 - DNA, 12 bp, Artificial Sequence
  Synthetic Oligonucleotide
cgggtactatgg

SEQ ID NO: 993 - DNA, 12 bp, Artificial Sequence
  Synthetic Oligonucleotide
ctacaccaggtc

SEQ ID NO: 994 - DNA, 12 bp, Artificial Sequence
  Synthetic Oligonucleotide
tatagctcctct

SEQ ID NO: 995 - DNA, 14 bp, Artificial Sequence
  Synthetic Oligonucleotide
catttagggtctaa

SEQ ID NO: 996 - DNA, 12 bp, Artificial Sequence
  Synthetic Oligonucleotide
atcttcagagat

SEQ ID NO: 997 - DNA, 12 bp, Artificial Sequence
  Synthetic Oligonucleotide
ttgatatagtca

SEQ ID NO: 998 - DNA, 12 bp, Artificial Sequence
  Synthetic Oligonucleotide
taatatgacttg

SEQ ID NO: 999 - DNA, 14 bp, Artificial Sequence
  Synthetic Oligonucleotide
agccgcctgaagtg

SEQ ID NO: 1000 - DNA, 12 bp, Artificial Sequence
  Synthetic Oligonucleotide
ccccagcagcgg

SEQ ID NO: 1001 - DNA, 12 bp, Artificial Sequence
  Synthetic Oligonucleotide
tccttccactga

SEQ ID NO: 1002 - DNA, 12 bp, Artificial Sequence
  Synthetic Oligonucleotide
cggtttttgttc

SEQ ID NO: 1003 - DNA, 14 bp, Artificial Sequence
  Synthetic Oligonucleotide
taaatcctctagca

SEQ ID NO: 1004 - DNA, 12 bp, Artificial Sequence
  Synthetic Oligonucleotide
gttccctctaca

SEQ ID NO: 1005 - DNA, 12 bp, Artificial Sequence
  Synthetic Oligonucleotide
acaccatctccc

SEQ ID NO: 1006 - DNA, 12 bp, Artificial Sequence
  Synthetic Oligonucleotide
gctccttccact

SEQ ID NO: 1007 - DNA, 14 bp, Artificial Sequence
  Synthetic Oligonucleotide
cactgatcctgcac

SEQ ID NO: 1008 - DNA, 12 bp, Artificial Sequence
  Synthetic Oligonucleotide
tcggactttgaa

SEQ ID NO: 1009 - DNA, 14 bp, Artificial Sequence
  Synthetic Oligonucleotide
tcggactttgaaaa

SEQ ID NO: 1010 - DNA, 14 bp, Artificial Sequence
  Synthetic Oligonucleotide
atcagccagacaga

SEQ ID NO: 1011 - DNA, 14 bp, Artificial Sequence
  Synthetic Oligonucleotide
catcagcaagaggc

SEQ ID NO: 1012 - DNA, 12 bp, Artificial Sequence
  Synthetic Oligonucleotide
ttgttcttagga

SEQ ID NO: 1013 - DNA, 12 bp, Artificial Sequence
  Synthetic Oligonucleotide
gccagacagaag

SEQ ID NO: 1014 - DNA, 12 bp, Artificial Sequence
  Synthetic Oligonucleotide
ttgtcgatctgc

SEQ ID NO: 1015 - DNA, 14 bp, Artificial Sequence
  Synthetic Oligonucleotide
ggagaagcgcagct

SEQ ID NO: 1016 - DNA, 12 bp, Artificial Sequence
  Synthetic Oligonucleotide
ggagaagcgcag

SEQ ID NO: 1017 - DNA, 14 bp, Artificial Sequence
  Synthetic Oligonucleotide
ctgcactgacgagt

SEQ ID NO: 1018 - DNA, 12 bp, Artificial Sequence
  Synthetic Oligonucleotide
ctgcaacatgat

SEQ ID NO: 1019 - DNA, 14 bp, Artificial Sequence
  Synthetic Oligonucleotide
ctgatccttagaag

SEQ ID NO: 1020 - DNA, 16 bp, Artificial Sequence
  Synthetic Oligonucleotide
ccttccactgatcctg

SEQ ID NO: 1021 - DNA, 12 bp, Artificial Sequence
  Synthetic Oligonucleotide
ctccttccactg

SEQ ID NO: 1022 - DNA, 14 bp, Artificial Sequence
  Synthetic Oligonucleotide
tgcagccatgtact

SEQ ID NO: 1023 - DNA, 12 bp, Artificial Sequence
  Synthetic Oligonucleotide
cgtttgggtggc

SEQ ID NO: 1024 - DNA, 14 bp, Artificial Sequence
  Synthetic Oligonucleotide
tccactgatcctgc

SEQ ID NO: 1025 - DNA, 14 bp, Artificial Sequence
  Synthetic Oligonucleotide
ttccactgatcctg

SEQ ID NO: 1026 - DNA, 12 bp, Artificial Sequence
  Synthetic Oligonucleotide
tccactgatcct

SEQ ID NO: 1027 - DNA, 14 bp, Artificial Sequence
  Synthetic Oligonucleotide
cttccactgatcct

SEQ ID NO: 1028 - DNA, 16 bp, Artificial Sequence
  Synthetic Oligonucleotide
tccttccactgatcct

SEQ ID NO: 1029 - DNA, 12 bp, Artificial Sequence
  Synthetic Oligonucleotide
ttccactgatcc

SEQ ID NO: 1030 - DNA, 16 bp, Artificial Sequence
  Synthetic Oligonucleotide
ctccttccactgatcc

SEQ ID NO: 1031 - DNA, 14 bp, Artificial Sequence
  Synthetic Oligonucleotide
tccttccactgatc

SEQ ID NO: 1032 - DNA, 16 bp, Artificial Sequence
  Synthetic Oligonucleotide
gctccttccactgatc

SEQ ID NO: 1033 - DNA, 14 bp, Artificial Sequence
  Synthetic Oligonucleotide
gctccttccactga

SEQ ID NO: 1034 - DNA, 16 bp, Artificial Sequence
  Synthetic Oligonucleotide
aagctccttccactga

SEQ ID NO: 1035 - DNA, 14 bp, Artificial Sequence
  Synthetic Oligonucleotide
aagctccttccact

SEQ ID NO: 1036 - DNA, 12 bp, Artificial Sequence
  Synthetic Oligonucleotide
agctccttccac

SEQ ID NO: 1037 - DNA, 16 bp, Artificial Sequence
  Synthetic Oligonucleotide
gggaaagctccttcca

SEQ ID NO: 1038 - DNA, 14 bp, Artificial Sequence
  Synthetic Oligonucleotide
ttgcaatgtctggc

SEQ ID NO: 1039 - DNA, 14 bp, Artificial Sequence
  Synthetic Oligonucleotide
gatttatctggctg

SEQ ID NO: 1040 - DNA, 12 bp, Artificial Sequence
  Synthetic Oligonucleotide
aagggccctggg

SEQ ID NO: 1041 - DNA, 12 bp, Artificial Sequence
  Synthetic Oligonucleotide
aacttcagtgtc

SEQ ID NO: 1042 - DNA, 12 bp, Artificial Sequence
  Synthetic Oligonucleotide
agggcttccagt

SEQ ID NO: 1043 - DNA, 12 bp, Artificial Sequence
  Synthetic Oligonucleotide
aggaagggcttc

SEQ ID NO: 1044 - DNA, 12 bp, Artificial Sequence
  Synthetic Oligonucleotide
ccttccactgat

SEQ ID NO: 1045 - DNA, 14 bp, Artificial Sequence
  Synthetic Oligonucleotide
ggaaacataccctg

SEQ ID NO: 1046 - DNA, 14 bp, Artificial Sequence
  Synthetic Oligonucleotide
ccttccactgatcc

SEQ ID NO: 1047 - DNA, 12 bp, Artificial Sequence
  Synthetic Oligonucleotide
cttccactgatc

SEQ ID NO: 1048 - DNA, 14 bp, Artificial Sequence
  Synthetic Oligonucleotide
gaataggttaaggc

SEQ ID NO: 1049 - DNA, 14 bp, Artificial Sequence
  Synthetic Oligonucleotide
aacaatgtgttgta

SEQ ID NO: 1050 - DNA, 12 bp, Artificial Sequence
  Synthetic Oligonucleotide
ccctctacacca

SEQ ID NO: 1051 - DNA, 14 bp, Artificial Sequence
  Synthetic Oligonucleotide
gcacacagctgagg

SEQ ID NO: 1052 - DNA, 14 bp, Artificial Sequence
  Synthetic Oligonucleotide
gtgcacacagctga

SEQ ID NO: 1053 - DNA, 14 bp, Artificial Sequence
  Synthetic Oligonucleotide
cagtgtgcacacag

SEQ ID NO: 1054 - DNA, 14 bp, Artificial Sequence
  Synthetic Oligonucleotide
ctcagtgtgcacac

SEQ ID NO: 1055 - DNA, 12 bp, Artificial Sequence
  Synthetic Oligonucleotide
cacccactggtg

SEQ ID NO: 1056 - DNA, 14 bp, Artificial Sequence
  Synthetic Oligonucleotide
catttccatggcca

SEQ ID NO: 1057 - DNA, 14 bp, Artificial Sequence
  Synthetic Oligonucleotide
accaaacagttcag

SEQ ID NO: 1058 - DNA, 12 bp, Artificial Sequence
  Synthetic Oligonucleotide
ttgaccaggaag

SEQ ID NO: 1059 - DNA, 12 bp, Artificial Sequence
  Synthetic Oligonucleotide
caggccatgtgg

SEQ ID NO: 1060 - DNA, 14 bp, Artificial Sequence
  Synthetic Oligonucleotide
agtcaggccatgtg

SEQ ID NO: 1061 - DNA, 12 bp, Artificial Sequence
  Synthetic Oligonucleotide
gcgcgagcccga

SEQ ID NO: 1062 - DNA, 12 bp, Artificial Sequence
  Synthetic Oligonucleotide
tgtgaggctcca

SEQ ID NO: 1063 - DNA, 12 bp, Artificial Sequence
  Synthetic Oligonucleotide
ccctgaaggttc

SEQ ID NO: 1064 - DNA, 14 bp, Artificial Sequence
  Synthetic Oligonucleotide
tttgataaagccct

SEQ ID NO: 1065 - DNA, 14 bp, Artificial Sequence
  Synthetic Oligonucleotide
caagaagaccttac

SEQ ID NO: 1066 - DNA, 14 bp, Artificial Sequence
  Synthetic Oligonucleotide
tgcacaggcaggtt

SEQ ID NO: 1067 - DNA, 12 bp, Artificial Sequence
  Synthetic Oligonucleotide
acagccaggtag

SEQ ID NO: 1068 - DNA, 14 bp, Artificial Sequence
  Synthetic Oligonucleotide
tggaaaactgcacc

SEQ ID NO: 1069 - DNA, 12 bp, Artificial Sequence
  Synthetic Oligonucleotide
tgggtggccggg

SEQ ID NO: 1070 - DNA, 12 bp, Artificial Sequence
  Synthetic Oligonucleotide
gggcttcttcca

SEQ ID NO: 1071 - DNA, 12 bp, Artificial Sequence
  Synthetic Oligonucleotide
gctgacatctcg

SEQ ID NO: 1072 - DNA, 14 bp, Artificial Sequence
  Synthetic Oligonucleotide
cagcctggcaccta

SEQ ID NO: 1073 - DNA, 12 bp, Artificial Sequence
  Synthetic Oligonucleotide
taaaaacaacaa

SEQ ID NO: 1074 - DNA, 12 bp, Artificial Sequence
  Synthetic Oligonucleotide
tttataaaactg

SEQ ID NO: 1075 - skipped

SEQ ID NO: 1076 - DNA, 14 bp, Artificial Sequence
  Synthetic Oligonucleotide
agtaaatattggct

SEQ ID NO: 1077 - DNA, 12 bp, Artificial Sequence
  Synthetic Oligonucleotide
gttgagcatgac

SEQ ID NO: 1078 - DNA, 12 bp, Artificial Sequence
  Synthetic Oligonucleotide
gtgcgctcccat

SEQ ID NO: 1079 - DNA, 14 bp, Artificial Sequence
  Synthetic Oligonucleotide
tcctgcactgacga

SEQ ID NO: 1080 - DNA, 16 bp, Artificial Sequence
  Synthetic Oligonucleotide
gatcctgcactgacga

SEQ ID NO: 1081 - DNA, 14 bp, Artificial Sequence
  Synthetic Oligonucleotide
gatcctgcactgac

SEQ ID NO: 1082 - DNA, 16 bp, Artificial Sequence
  Synthetic Oligonucleotide
ctgatcctgcactgac

SEQ ID NO: 1083 - DNA, 16 bp, Artificial Sequence
  Synthetic Oligonucleotide
tccactgatcctgcac

SEQ ID NO: 1084 - DNA, 14 bp, Artificial Sequence
  Synthetic Oligonucleotide
cgcgagatatctaa

SEQ ID NO: 1085 - DNA, 14 bp, Artificial Sequence
  Synthetic Oligonucleotide
cgcacctggtaaat

SEQ ID NO: 1086 - DNA, 14 bp, Artificial Sequence
  Synthetic Oligonucleotide
gttcaagcggccta

SEQ ID NO: 1087 - DNA, 14 bp, Artificial Sequence
  Synthetic Oligonucleotide
ccctttacacaagt

SEQ ID NO: 1088 - DNA, 14 bp, Artificial Sequence
  Synthetic Oligonucleotide
ctcaaaatagattt

SEQ ID NO: 1089 - DNA, 14 bp, Artificial Sequence
  Synthetic Oligonucleotide
cacatgagctattc

SEQ ID NO: 1090 - DNA, 14 bp, Artificial Sequence
  Synthetic Oligonucleotide
gtgaagtgagtcat

SEQ ID NO: 1091 - DNA, 14 bp, Artificial Sequence
  Synthetic Oligonucleotide
ggtcactcaagatg

SEQ ID NO: 1092 - DNA, 14 bp, Artificial Sequence
  Synthetic Oligonucleotide
ggactcactcagca

SEQ ID NO: 1093 - DNA, 14 bp, Artificial Sequence
  Synthetic Oligonucleotide
tcagggctactcat

SEQ ID NO: 1094 - DNA, 14 bp, Artificial Sequence
  Synthetic Oligonucleotide
cagcactagattca

SEQ ID NO: 1095 - DNA, 14 bp, Artificial Sequence
  Synthetic Oligonucleotide
tagcttaatgtaac

SEQ ID NO: 1096 - DNA, 14 bp, Artificial Sequence
  Synthetic Oligonucleotide
ttgtgacatctagg

SEQ ID NO: 1097 - DNA, 14 bp, Artificial Sequence
  Synthetic Oligonucleotide
gtgcctagcacaga

SEQ ID NO: 1098 - DNA, 12 bp, Artificial Sequence
  Synthetic Oligonucleotide
cagcctaccagt

SEQ ID NO: 1099 - DNA, 14 bp, Artificial Sequence
  Synthetic Oligonucleotide
acatgtcagtaatt

SEQ ID NO: 1100 - DNA, 14 bp, Artificial Sequence
  Synthetic Oligonucleotide
ctcatggacacaaa

SEQ ID NO: 1101 - DNA, 14 bp, Artificial Sequence
  Synthetic Oligonucleotide
ggaagttttcaagt

SEQ ID NO: 1102 - DNA, 14 bp, Artificial Sequence
  Synthetic Oligonucleotide
gaatctggaggtaa

SEQ ID NO: 1103 - DNA, 14 bp, Artificial Sequence
  Synthetic Oligonucleotide
agccccttggccgt

SEQ ID NO: 1104 - DNA, 14 bp, Artificial Sequence
  Synthetic Oligonucleotide
gaatacttcaaatc

SEQ ID NO: 1105 - DNA, 14 bp, Artificial Sequence
  Synthetic Oligonucleotide
ctgatcctgcactg

SEQ ID NO: 1106 - DNA, 14 bp, Artificial Sequence
  Synthetic Oligonucleotide
tttgaggagctatt

SEQ ID NO: 1107 - DNA, 12 bp, Artificial Sequence
  Synthetic Oligonucleotide
ttgttgttccct

SEQ ID NO: 1108 - DNA, 12 bp, Artificial Sequence
  Synthetic Oligonucleotide
gagttgttgttc

SEQ ID NO: 1109 - DNA, 12 bp, Artificial Sequence
  Synthetic Oligonucleotide
cgagttgttgtt

SEQ ID NO: 1110 - DNA, 12 bp, Artificial Sequence
  Synthetic Oligonucleotide
gcgctaggccgc

SEQ ID NO: 1111 - DNA, 12 bp, Artificial Sequence
  Synthetic Oligonucleotide
gttgttgttccc

SEQ ID NO: 1112 - DNA, 12 bp, Artificial Sequence
  Synthetic Oligonucleotide
agttgttgttcc

SEQ ID NO: 1113 - DNA, 12 bp, Artificial Sequence
  Synthetic Oligonucleotide
ctcaccttcatg

SEQ ID NO: 1114 - DNA, 14 bp, Artificial Sequence
  Synthetic Oligonucleotide
cttagaaggcagca

SEQ ID NO: 1115 - DNA, 12 bp, Artificial Sequence
  Synthetic Oligonucleotide
gttgttccctct

SEQ ID NO: 1116 - DNA, 12 bp, Artificial Sequence
  Synthetic Oligonucleotide
ccaactccaact

SEQ ID NO: 1117 - DNA, 12 bp, Artificial Sequence
  Synthetic Oligonucleotide
gatctctcgagt

SEQ ID NO: 1118 - DNA, 12 bp, Artificial Sequence
  Synthetic Oligonucleotide
aatgcaggatct

SEQ ID NO: 1119 - DNA, 12 bp, Artificial Sequence
  Synthetic Oligonucleotide
ctcggactttga

SEQ ID NO: 1120 - DNA, 12 bp, Artificial Sequence
  Synthetic Oligonucleotide
tgactctcggac

SEQ ID NO: 1121 - DNA, 12 bp, Artificial Sequence
  Synthetic Oligonucleotide
cttgtccatcag

SEQ ID NO: 1122 - DNA, 12 bp, Artificial Sequence
  Synthetic Oligonucleotide
gggtctttcctc

SEQ ID NO: 1123 - DNA, 16 bp, Artificial Sequence
  Synthetic Oligonucleotide
cactgatccttagaag

SEQ ID NO: 1124 - DNA, 14 bp, Artificial Sequence
  Synthetic Oligonucleotide
cactgatccttaga

SEQ ID NO: 1125 - DNA, 16 bp, Artificial Sequence
  Synthetic Oligonucleotide
tccactgatccttaga

SEQ ID NO: 1126 - DNA, 16 bp, Artificial Sequence
  Synthetic Oligonucleotide
cttccactgatcctgc

SEQ ID NO: 1127 - DNA, 14 bp, Artificial Sequence
  Synthetic Oligonucleotide
tccactgatcctta

SEQ ID NO: 1128 - DNA, 12 bp, Artificial Sequence
  Synthetic Oligonucleotide
cagtggaccaca

SEQ ID NO: 1129 - DNA, 12 bp, Artificial Sequence
  Synthetic Oligonucleotide
tgcgagttgttg

SEQ ID NO: 1130 - DNA, 12 bp, Artificial Sequence
  Synthetic Oligonucleotide
aaagtcaggcca

SEQ ID NO: 1131 - DNA, 14 bp, Artificial Sequence
  Synthetic Oligonucleotide
taacttcagtgtct

SEQ ID NO: 1132 - DNA, 14 bp, Artificial Sequence
  Synthetic Oligonucleotide
gaagggcttccagt

SEQ ID NO: 1133 - DNA, 14 bp, Artificial Sequence
  Synthetic Oligonucleotide
tgaccaggaagggc

SEQ ID NO: 1134 - DNA, 14 bp, Artificial Sequence
  Synthetic Oligonucleotide
aggccctgagatta

SEQ ID NO: 1135 - DNA, 14 bp, Artificial Sequence
  Synthetic Oligonucleotide
ggttaaggccctga

SEQ ID NO: 1136 - DNA, 14 bp, Artificial Sequence
  Synthetic Oligonucleotide
ggaatgtctgagtt

SEQ ID NO: 1137 - DNA, 14 bp, Artificial Sequence
  Synthetic Oligonucleotide
taatgacctgatga

SEQ ID NO: 1138 - DNA, 12 bp, Artificial Sequence
  Synthetic Oligonucleotide
tgaagttaattc

SEQ ID NO: 1139 - DNA, 12 bp, Artificial Sequence
  Synthetic Oligonucleotide
gaaattgaggaa

SEQ ID NO: 1140 - DNA, 12 bp, Artificial Sequence
  Synthetic Oligonucleotide
gtattcaagtaa

SEQ ID NO: 1141 - DNA, 12 bp, Artificial Sequence
  Synthetic Oligonucleotide
acaattatggca

SEQ ID NO: 1142 - DNA, 12 bp, Artificial Sequence
  Synthetic Oligonucleotide
cagtttattcaa

SEQ ID NO: 1143 - DNA, 12 bp, Artificial Sequence
  Synthetic Oligonucleotide
gaagctgctggt

SEQ ID NO: 1144 - DNA, 12 bp, Artificial Sequence
  Synthetic Oligonucleotide
gtgaaacatttt

SEQ ID NO: 1145 - DNA, 14 bp, Artificial Sequence
  Synthetic Oligonucleotide
aaaagtgaaacatt

SEQ ID NO: 1146 - DNA, 12 bp, Artificial Sequence
  Synthetic Oligonucleotide
ttcttaaaggtg

SEQ ID NO: 1147 - DNA, 12 bp, Artificial Sequence
  Synthetic Oligonucleotide
gcacaaattttc

SEQ ID NO: 1148 - DNA, 12 bp, Artificial Sequence
  Synthetic Oligonucleotide
gtttagtgcaca

SEQ ID NO: 1149 - DNA, 12 bp, Artificial Sequence
  Synthetic Oligonucleotide
tctggatcagag

SEQ ID NO: 1150 - DNA, 12 bp, Artificial Sequence
  Synthetic Oligonucleotide
tgctgcacatcc

SEQ ID NO: 1151 - DNA, 12 bp, Artificial Sequence
  Synthetic Oligonucleotide
tctgactgggaa

SEQ ID NO: 1152 - DNA, 12 bp, Artificial Sequence
  Synthetic Oligonucleotide
acaaagagtccc

SEQ ID NO: 1153 - DNA, 12 bp, Artificial Sequence
  Synthetic Oligonucleotide
agagagctgagc

SEQ ID NO: 1154 - DNA, 12 bp, Artificial Sequence
  Synthetic Oligonucleotide
tggcctcacagc

SEQ ID NO: 1155 - DNA, 12 bp, Artificial Sequence
  Synthetic Oligonucleotide
ggaccgcagccg

SEQ ID NO: 1156 - DNA, 12 bp, Artificial Sequence
  Synthetic Oligonucleotide
gttagaacagac

SEQ ID NO: 1157 - DNA, 12 bp, Artificial Sequence
  Synthetic Oligonucleotide
cctgaaactgca

SEQ ID NO: 1158 - DNA, 12 bp, Artificial Sequence
  Synthetic Oligonucleotide
tgctcacaggcg

SEQ ID NO: 1159 - DNA, 12 bp, Artificial Sequence
  Synthetic Oligonucleotide
agagagcaactc

SEQ ID NO: 1160 - DNA, 12 bp, Artificial Sequence
  Synthetic Oligonucleotide
atggctgctgcg

SEQ ID NO: 1161 - DNA, 12 bp, Artificial Sequence
  Synthetic Oligonucleotide
catggctgcagc

SEQ ID NO: 1162 - DNA, 14 bp, Artificial Sequence
  Synthetic Oligonucleotide
cttggccctggacc

SEQ ID NO: 1163 - DNA, 13 bp, Artificial Sequence
  Synthetic Oligonucleotide
gctagcctctgga

SEQ ID NO: 1164 - DNA, 12 bp, Artificial Sequence
  Synthetic Oligonucleotide
tggccctggacc

SEQ ID NO: 1165 - DNA, 12 bp, Artificial Sequence
  Synthetic Oligonucleotide
tttctgcaggaa

SEQ ID NO: 1166 - DNA, 14 bp, Artificial Sequence
  Synthetic Oligonucleotide
tacaggtcaagtct

SEQ ID NO: 1167 - DNA, 12 bp, Artificial Sequence
  Synthetic Oligonucleotide
acaggtcaagtc

SEQ ID NO: 1168 - DNA, 14 bp, Artificial Sequence
  Synthetic Oligonucleotide
ttggataaatatct

SEQ ID NO: 1169 - DNA, 12 bp, Artificial Sequence
  Synthetic Oligonucleotide
tggataaatatc

SEQ ID NO: 1170 - DNA, 12 bp, Artificial Sequence
  Synthetic Oligonucleotide
ttctgcaggatg

SEQ ID NO: 1171 - DNA, 12 bp, Artificial Sequence
  Synthetic Oligonucleotide
caccttcaagtc

SEQ ID NO: 1172 - DNA, 12 bp, Artificial Sequence
  Synthetic Oligonucleotide
catagattgtat

SEQ ID NO: 1173 - DNA, 12 bp, Artificial Sequence
  Synthetic Oligonucleotide
gtcagaatatct

SEQ ID NO: 1174 - DNA, 12 bp, Artificial Sequence
  Synthetic Oligonucleotide
tctgcagttaaa

SEQ ID NO: 1175 - DNA, 12 bp, Artificial Sequence
  Synthetic Oligonucleotide
atcttgtgaaac

SEQ ID NO: 1176 - DNA, 12 bp, Artificial Sequence
  Synthetic Oligonucleotide
tcatcaaaaggt

SEQ ID NO: 1177 - DNA, 12 bp, Artificial Sequence
  Synthetic Oligonucleotide
ctttgtcaagat

SEQ ID NO: 1178 - DNA, 12 bp, Artificial Sequence
  Synthetic Oligonucleotide
tatgcacaaatc

SEQ ID NO: 1179 - DNA, 12 bp, Artificial Sequence
  Synthetic Oligonucleotide
taatccaggtga

SEQ ID NO: 1180 - DNA, 12 bp, Artificial Sequence
  Synthetic Oligonucleotide
cacacaggcaat

SEQ ID NO: 1181 - DNA, 12 bp, Artificial Sequence
  Synthetic Oligonucleotide
ttgagcatcttg

SEQ ID NO: 1182 - DNA, 14 bp, Artificial Sequence
  Synthetic Oligonucleotide
cattttgtcctttt

SEQ ID NO: 1183 - DNA, 12 bp, Artificial Sequence
  Synthetic Oligonucleotide
gatttcctgatc

SEQ ID NO: 1184 - DNA, 15 bp, Artificial Sequence
  Synthetic Oligonucleotide
ctggatttgatggct

SEQ ID NO: 1185 - DNA, 15 bp, Artificial Sequence
  Synthetic Oligonucleotide
tctggatttgatggc

SEQ ID NO: 1186 - DNA, 12 bp, Artificial Sequence
  Synthetic Oligonucleotide
tggacttggcgg

SEQ ID NO: 1187 - DNA, 15 bp, Artificial Sequence
  Synthetic Oligonucleotide
ctctggatttgatgg

SEQ ID NO: 1188 - DNA, 15 bp, Artificial Sequence
  Synthetic Oligonucleotide
cctctggatttgatg

SEQ ID NO: 1189 - DNA, 15 bp, Artificial Sequence
  Synthetic Oligonucleotide
gcctctggatttgat

SEQ ID NO: 1190 - DNA, 16 bp, Artificial Sequence
  Synthetic Oligonucleotide
tttagcctctggattt

SEQ ID NO: 1191 - DNA, 16 bp, Artificial Sequence
  Synthetic Oligonucleotide
tctagcctctggattt

SEQ ID NO: 1192 - DNA, 12 bp, Artificial Sequence
  Synthetic Oligonucleotide
agtagttgtact

SEQ ID NO: 1193 - DNA, 12 bp, Artificial Sequence
  Synthetic Oligonucleotide
tctggagtcaca

SEQ ID NO: 1194 - DNA, 12 bp, Artificial Sequence
  Synthetic Oligonucleotide
gtcataatgtct

SEQ ID NO: 1195 - DNA, 14 bp, Artificial Sequence
  Synthetic Oligonucleotide
gtgtcataatgtct

SEQ ID NO: 1196 - DNA, 12 bp, Artificial Sequence
  Synthetic Oligonucleotide
cttcaaaaggat

SEQ ID NO: 1197 - DNA, 12 bp, Artificial Sequence
  Synthetic Oligonucleotide
gtcttcaaaagg

SEQ ID NO: 1198 - DNA, 12 bp, Artificial Sequence
  Synthetic Oligonucleotide
atcctcttgata

SEQ ID NO: 1199 - DNA, 12 bp, Artificial Sequence
  Synthetic Oligonucleotide
gtgcctttaaaa

SEQ ID NO: 1200 - DNA, 12 bp, Artificial Sequence
  Synthetic Oligonucleotide
tgtcataatgtc

SEQ ID NO: 1201 - DNA, 12 bp, Artificial Sequence
  Synthetic Oligonucleotide
caatctgacaca

SEQ ID NO: 1202 - DNA, 12 bp, Artificial Sequence
  Synthetic Oligonucleotide
aatattgttcct

SEQ ID NO: 1203 - DNA, 12 bp, Artificial Sequence
  Synthetic Oligonucleotide
gtcaggagaaga

SEQ ID NO: 1204 - DNA, 12 bp, Artificial Sequence
  Synthetic Oligonucleotide
tgtcaaaaccac

SEQ ID NO: 1205 - DNA, 12 bp, Artificial Sequence
  Synthetic Oligonucleotide
gtcctattgcca

SEQ ID NO: 1206 - DNA, 12 bp, Artificial Sequence
  Synthetic Oligonucleotide
aggtatatacat

SEQ ID NO: 1207 - DNA, 12 bp, Artificial Sequence
  Synthetic Oligonucleotide
cagctggtgaca

SEQ ID NO: 1208 - DNA, 12 bp, Artificial Sequence
  Synthetic Oligonucleotide
ttcacttagcca

SEQ ID NO: 1209 - DNA, 12 bp, Artificial Sequence
  Synthetic Oligonucleotide
aaccctgcagaa

SEQ ID NO: 1210 - DNA, 12 bp, Artificial Sequence
  Synthetic Oligonucleotide
tgtcaaaaccct

SEQ ID NO: 1211 - DNA, 12 bp, Artificial Sequence
  Synthetic Oligonucleotide
gtgtcaaaaccc

SEQ ID NO: 1212 - DNA, 14 bp, Artificial Sequence
  Synthetic Oligonucleotide
atggtccagagccc

SEQ ID NO: 1213 - DNA, 12 bp, Artificial Sequence
  Synthetic Oligonucleotide
tggtccagagcc

SEQ ID NO: 1214 - DNA, 12 bp, Artificial Sequence
  Synthetic Oligonucleotide
tgggttatggtc

SEQ ID NO: 1215 - DNA, 12 bp, Artificial Sequence
  Synthetic Oligonucleotide
caaagaatggtg

SEQ ID NO: 1216 - DNA, 12 bp, Artificial Sequence
  Synthetic Oligonucleotide
gtttagcatgct

SEQ ID NO: 1217 - DNA, 12 bp, Artificial Sequence
  Synthetic Oligonucleotide
tgcctttaaaaa

SEQ ID NO: 1218 - DNA, 12 bp, Artificial Sequence
  Synthetic Oligonucleotide
accaatatgctc

SEQ ID NO: 1219 - DNA, 12 bp, Artificial Sequence
  Synthetic Oligonucleotide
caccaataagtt

SEQ ID NO: 1220 - DNA, 12 bp, Artificial Sequence
  Synthetic Oligonucleotide
cctttagctggc

SEQ ID NO: 1221 - DNA, 12 bp, Artificial Sequence
  Synthetic Oligonucleotide
gttgaaagcctc

SEQ ID NO: 1222 - DNA, 12 bp, Artificial Sequence
  Synthetic Oligonucleotide
tttgatgatggc

SEQ ID NO: 1223 - DNA, 12 bp, Artificial Sequence
  Synthetic Oligonucleotide
tcattgtcaaat

SEQ ID NO: 1224 - DNA, 12 bp, Artificial Sequence
  Synthetic Oligonucleotide
ttacaactgaga

SEQ ID NO: 1225 - DNA, 12 bp, Artificial Sequence
  Synthetic Oligonucleotide
agatggagcagt

SEQ ID NO: 1226 - DNA, 14 bp, Artificial Sequence
  Synthetic Oligonucleotide
cttagcactggcct

SEQ ID NO: 1227 - DNA, 12 bp, Artificial Sequence
  Synthetic Oligonucleotide
agagtatctgaa

SEQ ID NO: 1228 - DNA, 12 bp, Artificial Sequence
  Synthetic Oligonucleotide
actgatgtaggg

SEQ ID NO: 1229 - DNA, 12 bp, Artificial Sequence
  Synthetic Oligonucleotide
ccacagtaggta

SEQ ID NO: 1230 - DNA, 14 bp, Artificial Sequence
  Synthetic Oligonucleotide
ctggcagccagcac

SEQ ID NO: 1231 - DNA, 12 bp, Artificial Sequence
  Synthetic Oligonucleotide
tggcagccagca

SEQ ID NO: 1232 - DNA, 12 bp, Artificial Sequence
  Synthetic Oligonucleotide
gcatcatcaatc

SEQ ID NO: 1233 - DNA, 12 bp, Artificial Sequence
  Synthetic Oligonucleotide
aaatcattgtca

SEQ ID NO: 1234 - DNA, 12 bp, Artificial Sequence
  Synthetic Oligonucleotide
gcaaaactcatt

SEQ ID NO: 1235 - DNA, 14 bp, Artificial Sequence
  Synthetic Oligonucleotide
tgtgcaactctgca

SEQ ID NO: 1236 - DNA, 12 bp, Artificial Sequence
  Synthetic Oligonucleotide
gtgcaactctgc

SEQ ID NO: 1237 - DNA, 12 bp, Artificial Sequence
  Synthetic Oligonucleotide
aatattcatgta

SEQ ID NO: 1238 - DNA, 12 bp, Artificial Sequence
  Synthetic Oligonucleotide
ggattgcaagtt

SEQ ID NO: 1239 - DNA, 12 bp, Artificial Sequence
  Synthetic Oligonucleotide
ataaagcatctg

SEQ ID NO: 1240 - DNA, 12 bp, Artificial Sequence
  Synthetic Oligonucleotide
ccactgaacatt

SEQ ID NO: 1241 - DNA, 12 bp, Artificial Sequence
  Synthetic Oligonucleotide
gaagccctaatc

SEQ ID NO: 1242 - DNA, 12 bp, Artificial Sequence
  Synthetic Oligonucleotide
taaattgtatgc

SEQ ID NO: 1243 - DNA, 12 bp, Artificial Sequence
  Synthetic Oligonucleotide
aagatcttcaca

SEQ ID NO: 1244 - DNA, 12 bp, Artificial Sequence
  Synthetic Oligonucleotide
caagatcttcac

SEQ ID NO: 1245 - DNA, 12 bp, Artificial Sequence
  Synthetic Oligonucleotide
atgtcaaggtca

SEQ ID NO: 1246 - DNA, 12 bp, Artificial Sequence
  Synthetic Oligonucleotide
ataatggctgga

SEQ ID NO: 1247 - DNA, 14 bp, Artificial Sequence
  Synthetic Oligonucleotide
agcaccaatatgct

SEQ ID NO: 1248 - DNA, 12 bp, Artificial Sequence
  Synthetic Oligonucleotide
gcaccaatatgc

SEQ ID NO: 1249 - DNA, 12 bp, Artificial Sequence
  Synthetic Oligonucleotide
tggcagaccaca

SEQ ID NO: 1250 - DNA, 12 bp, Artificial Sequence
  Synthetic Oligonucleotide
tcctatgcaatc

SEQ ID NO: 1251 - DNA, 12 bp, Artificial Sequence
  Synthetic Oligonucleotide
tataaatgcttc

SEQ ID NO: 1252 - DNA, 12 bp, Artificial Sequence
  Synthetic Oligonucleotide
gtcaaattctat

SEQ ID NO: 1253 - DNA, 12 bp, Artificial Sequence
  Synthetic Oligonucleotide
ttcaggctaatc

SEQ ID NO: 1254 - DNA, 12 bp, Artificial Sequence
  Synthetic Oligonucleotide
ctgatgaggtat

SEQ ID NO: 1255 - DNA, 12 bp, Artificial Sequence
  Synthetic Oligonucleotide
ggtgtcagaata

SEQ ID NO: 1256 - DNA, 12 bp, Artificial Sequence
  Synthetic Oligonucleotide
tttgaaagacac

SEQ ID NO: 1257 - skipped

SEQ ID NO: 1258 - DNA, 12 bp, Artificial Sequence
  Synthetic Oligonucleotide
tgcaacagccca

SEQ ID NO: 1259 - DNA, 14 bp, Artificial Sequence
  Synthetic Oligonucleotide
aaagagtcccgcca

SEQ ID NO: 1260 - DNA, 12 bp, Artificial Sequence
  Synthetic Oligonucleotide
aagagtcccgcc

SEQ ID NO: 1261 - DNA, 14 bp, Artificial Sequence
  Synthetic Oligonucleotide
tccgagaggagaga

SEQ ID NO: 1262 - DNA, 12 bp, Artificial Sequence
  Synthetic Oligonucleotide
ccgagaggagag

SEQ ID NO: 1263 - DNA, 14 bp, Artificial Sequence
  Synthetic Oligonucleotide
tcatggctgcagct

SEQ ID NO: 1264 - DNA, 14 bp, Artificial Sequence
  Synthetic Oligonucleotide
acagcggctcaact

SEQ ID NO: 1265 - DNA, 12 bp, Artificial Sequence
  Synthetic Oligonucleotide
cagcggctcaac

SEQ ID NO: 1266 - DNA, 14 bp, Artificial Sequence
  Synthetic Oligonucleotide
ggtgacaggcgact

SEQ ID NO: 1267 - DNA, 12 bp, Artificial Sequence
  Synthetic Oligonucleotide
gtgacaggcgac

SEQ ID NO: 1268 - DNA, 12 bp, Artificial Sequence
  Synthetic Oligonucleotide
atggtgacaggc

SEQ ID NO: 1269 - DNA, 12 bp, Artificial Sequence
  Synthetic Oligonucleotide
agaggcctggca

SEQ ID NO: 1270 - DNA, 12 bp, Artificial Sequence
  Synthetic Oligonucleotide
ctggatggttgc

SEQ ID NO: 1271 - DNA, 14 bp, Artificial Sequence
  Synthetic Oligonucleotide
aatggctgctgcgg

SEQ ID NO: 1272 - DNA, 12 bp, Artificial Sequence
  Synthetic Oligonucleotide
ccgggtaatggc

SEQ ID NO: 1273 - DNA, 14 bp, Artificial Sequence
  Synthetic Oligonucleotide
tggaccgcagccgg

SEQ ID NO: 1274 - DNA, 14 bp, Artificial Sequence
  Synthetic Oligonucleotide
tgatgcccctcgct

SEQ ID NO: 1275 - DNA, 12 bp, Artificial Sequence
  Synthetic Oligonucleotide
gatgcccctcgc

SEQ ID NO: 1276 - DNA, 14 bp, Artificial Sequence
  Synthetic Oligonucleotide
ctggacttggcggt

SEQ ID NO: 1277 - DNA, 14 bp, Artificial Sequence
  Synthetic Oligonucleotide
ggaaatggctctgg

SEQ ID NO: 1278 - DNA, 12 bp, Artificial Sequence
  Synthetic Oligonucleotide
gaaatggctctg

SEQ ID NO: 1279 - DNA, 14 bp, Artificial Sequence
  Synthetic Oligonucleotide
agaagctgctggtg

SEQ ID NO: 1280 - DNA, 12 bp, Artificial Sequence
  Synthetic Oligonucleotide
gatggcagaagc

SEQ ID NO: 1281 - DNA, 14 bp, Artificial Sequence
  Synthetic Oligonucleotide
agagagatggcaga

SEQ ID NO: 1282 - DNA, 12 bp, Artificial Sequence
  Synthetic Oligonucleotide
gagagatggcag

SEQ ID NO: 1283 - DNA, 14 bp, Artificial Sequence
  Synthetic Oligonucleotide
gtggctgaagaaaa

SEQ ID NO: 1284 - DNA, 12 bp, Artificial Sequence
  Synthetic Oligonucleotide
tggctgaagaaa

SEQ ID NO: 1285 - DNA, 14 bp, Artificial Sequence
  Synthetic Oligonucleotide
atgtctgggagcct

SEQ ID NO: 1286 - DNA, 12 bp, Artificial Sequence
  Synthetic Oligonucleotide
tgtctgggagcc

SEQ ID NO: 1287 - DNA, 14 bp, Artificial Sequence
  Synthetic Oligonucleotide
atgatggctgtcat

SEQ ID NO: 1288 - DNA, 12 bp, Artificial Sequence
  Synthetic Oligonucleotide
tgatgatggctg

SEQ ID NO: 1289 - DNA, 14 bp, Artificial Sequence
  Synthetic Oligonucleotide
ctttgatgatggct

SEQ ID NO: 1290 - DNA, 14 bp, Artificial Sequence
  Synthetic Oligonucleotide
acgatctctttgat

SEQ ID NO: 1291 - DNA, 14 bp, Artificial Sequence
  Synthetic Oligonucleotide
tgtttctgctaacg

SEQ ID NO: 1292 - DNA, 12 bp, Artificial Sequence
  Synthetic Oligonucleotide
gtttctgctaac

SEQ ID NO: 1293 - DNA, 14 bp, Artificial Sequence
  Synthetic Oligonucleotide
tttgtttctgctaa

SEQ ID NO: 1294 - DNA, 14 bp, Artificial Sequence
  Synthetic Oligonucleotide
cttgatatctcctt

SEQ ID NO: 1295 - DNA, 14 bp, Artificial Sequence
  Synthetic Oligonucleotide
catcctcttgatat

SEQ ID NO: 1296 - DNA, 14 bp, Artificial Sequence
  Synthetic Oligonucleotide
aatccatcctcttg

SEQ ID NO: 1297 - DNA, 12 bp, Artificial Sequence
  Synthetic Oligonucleotide
gaatccatcctc

SEQ ID NO: 1298 - DNA, 14 bp, Artificial Sequence
  Synthetic Oligonucleotide
gtctaagtcgaatc

SEQ ID NO: 1299 - DNA, 12 bp, Artificial Sequence
  Synthetic Oligonucleotide
caagtctaagtc

SEQ ID NO: 1300 - DNA, 12 bp, Artificial Sequence
  Synthetic Oligonucleotide
aggtcaagtcta

SEQ ID NO: 1301 - DNA, 14 bp, Artificial Sequence
  Synthetic Oligonucleotide
cgcagaaatggata

SEQ ID NO: 1302 - DNA, 12 bp, Artificial Sequence
  Synthetic Oligonucleotide
gcagaaatggat

SEQ ID NO: 1303 - DNA, 14 bp, Artificial Sequence
  Synthetic Oligonucleotide
ttcgcatccgtcta

SEQ ID NO: 1304 - DNA, 12 bp, Artificial Sequence
  Synthetic Oligonucleotide
tcgcatccgtct

SEQ ID NO: 1305 - DNA, 14 bp, Artificial Sequence
  Synthetic Oligonucleotide
ccctaggttgaata

SEQ ID NO: 1306 - DNA, 12 bp, Artificial Sequence
  Synthetic Oligonucleotide
cctaggttgaat

SEQ ID NO: 1307 - DNA, 14 bp, Artificial Sequence
  Synthetic Oligonucleotide
gttatgcaaatcag

SEQ ID NO: 1308 - DNA, 12 bp, Artificial Sequence
  Synthetic Oligonucleotide
ttatgcaaatca

SEQ ID NO: 1309 - DNA, 14 bp, Artificial Sequence
  Synthetic Oligonucleotide
tgactcagtaaatt

SEQ ID NO: 1310 - DNA, 12 bp, Artificial Sequence
  Synthetic Oligonucleotide
gactcagtaaat

SEQ ID NO: 1311 - DNA, 14 bp, Artificial Sequence
  Synthetic Oligonucleotide
ttaaaattcttggg

SEQ ID NO: 1312 - DNA, 12 bp, Artificial Sequence
  Synthetic Oligonucleotide
taaaattcttgg

SEQ ID NO: 1313 - DNA, 14 bp, Artificial Sequence
  Synthetic Oligonucleotide
cctaacttttagac

SEQ ID NO: 1314 - DNA, 12 bp, Artificial Sequence
  Synthetic Oligonucleotide
ctaacttttaga

SEQ ID NO: 1315 - DNA, 14 bp, Artificial Sequence
  Synthetic Oligonucleotide
acctgaaactgcaa

SEQ ID NO: 1316 - DNA, 14 bp, Artificial Sequence
  Synthetic Oligonucleotide
gtgtcaaaaccact

SEQ ID NO: 1317 - DNA, 14 bp, Artificial Sequence
  Synthetic Oligonucleotide
cctattcccactga

SEQ ID NO: 1318 - DNA, 12 bp, Artificial Sequence
  Synthetic Oligonucleotide
ctattcccactg

SEQ ID NO: 1319 - DNA, 14 bp, Artificial Sequence
  Synthetic Oligonucleotide
cccatagcaataat

SEQ ID NO: 1320 - DNA, 12 bp, Artificial Sequence
  Synthetic Oligonucleotide
ccatagcaataa

SEQ ID NO: 1321 - DNA, 12 bp, Artificial Sequence
  Synthetic Oligonucleotide
atcccatagcaa

SEQ ID NO: 1322 - DNA, 14 bp, Artificial Sequence
  Synthetic Oligonucleotide
tctgcaggaaatcc

SEQ ID NO: 1323 - DNA, 12 bp, Artificial Sequence
  Synthetic Oligonucleotide
ctgcaggaaatc

SEQ ID NO: 1324 - DNA, 14 bp, Artificial Sequence
  Synthetic Oligonucleotide
ttctgcaggaaatc

SEQ ID NO: 1325 - DNA, 14 bp, Artificial Sequence
  Synthetic Oligonucleotide
ccttcaagtctttc

SEQ ID NO: 1326 - DNA, 14 bp, Artificial Sequence
  Synthetic Oligonucleotide
ttgttcctgtatac

SEQ ID NO: 1327 - DNA, 14 bp, Artificial Sequence
  Synthetic Oligonucleotide
caatattgttcctg

SEQ ID NO: 1328 - DNA, 12 bp, Artificial Sequence
  Synthetic Oligonucleotide
caatattgttcc

SEQ ID NO: 1329 - DNA, 14 bp, Artificial Sequence
  Synthetic Oligonucleotide
acatcatcaatatt

SEQ ID NO: 1330 - DNA, 14 bp, Artificial Sequence
  Synthetic Oligonucleotide
ctttgaatccaaaa

SEQ ID NO: 1331 - DNA, 12 bp, Artificial Sequence
  Synthetic Oligonucleotide
tttgaatccaaa

SEQ ID NO: 1332 - DNA, 14 bp, Artificial Sequence
  Synthetic Oligonucleotide
tatgctttgaatcc

SEQ ID NO: 1333 - DNA, 14 bp, Artificial Sequence
  Synthetic Oligonucleotide
ttgtaatggttttt

SEQ ID NO: 1334 - DNA, 12 bp, Artificial Sequence
  Synthetic Oligonucleotide
atcttgtaatgg

SEQ ID NO: 1335 - DNA, 14 bp, Artificial Sequence
  Synthetic Oligonucleotide
agattgtatatctt

SEQ ID NO: 1336 - DNA, 14 bp, Artificial Sequence
  Synthetic Oligonucleotide
cggtgtcataatgt

SEQ ID NO: 1337 - DNA, 14 bp, Artificial Sequence
  Synthetic Oligonucleotide
aaatttggcggtgt

SEQ ID NO: 1338 - DNA, 14 bp, Artificial Sequence
  Synthetic Oligonucleotide
ttaaatttggcggt

SEQ ID NO: 1339 - DNA, 12 bp, Artificial Sequence
  Synthetic Oligonucleotide
taaatttggcgg

SEQ ID NO: 1340 - DNA, 14 bp, Artificial Sequence
  Synthetic Oligonucleotide
tcttcaaaaggata

SEQ ID NO: 1341 - DNA, 12 bp, Artificial Sequence
  Synthetic Oligonucleotide
tggtcttcaaaa

SEQ ID NO: 1342 - DNA, 14 bp, Artificial Sequence
  Synthetic Oligonucleotide
gtgggttatggtct

SEQ ID NO: 1343 - DNA, 14 bp, Artificial Sequence
  Synthetic Oligonucleotide
aagttctagctgtg

SEQ ID NO: 1344 - DNA, 12 bp, Artificial Sequence
  Synthetic Oligonucleotide
ataagttctagc

SEQ ID NO: 1345 - DNA, 14 bp, Artificial Sequence
  Synthetic Oligonucleotide
aagggtttgataag

SEQ ID NO: 1346 - DNA, 14 bp, Artificial Sequence
  Synthetic Oligonucleotide
tcaagatcttcaca

SEQ ID NO: 1347 - DNA, 14 bp, Artificial Sequence
  Synthetic Oligonucleotide
agccattggtcaag

SEQ ID NO: 1348 - DNA, 14 bp, Artificial Sequence
  Synthetic Oligonucleotide
tcttcacttagcca

SEQ ID NO: 1349 - DNA, 14 bp, Artificial Sequence
  Synthetic Oligonucleotide
tgctgcaacatgat

SEQ ID NO: 1350 - DNA, 12 bp, Artificial Sequence
  Synthetic Oligonucleotide
gctgcaacatga

SEQ ID NO: 1351 - DNA, 14 bp, Artificial Sequence
  Synthetic Oligonucleotide
ttacagtgaattgc

SEQ ID NO: 1352 - DNA, 12 bp, Artificial Sequence
  Synthetic Oligonucleotide
ccagctttacag

SEQ ID NO: 1353 - DNA, 12 bp, Artificial Sequence
  Synthetic Oligonucleotide
cattacaccagt

SEQ ID NO: 1354 - DNA, 14 bp, Artificial Sequence
  Synthetic Oligonucleotide
atcattacaccagt

SEQ ID NO: 1355 - DNA, 12 bp, Artificial Sequence
  Synthetic Oligonucleotide
tcattacaccag

SEQ ID NO: 1356 - DNA, 14 bp, Artificial Sequence
  Synthetic Oligonucleotide
aataaatatgcaca

SEQ ID NO: 1357 - DNA, 14 bp, Artificial Sequence
  Synthetic Oligonucleotide
tgtgcctttaaaaa

SEQ ID NO: 1358 - DNA, 14 bp, Artificial Sequence
  Synthetic Oligonucleotide
ttgtgcctttaaaa

SEQ ID NO: 1359 - DNA, 14 bp, Artificial Sequence
  Synthetic Oligonucleotide
gggcctcttgtgcc

SEQ ID NO: 1360 - DNA, 14 bp, Artificial Sequence
  Synthetic Oligonucleotide
ccttacttccccat

SEQ ID NO: 1361 - DNA, 14 bp, Artificial Sequence
  Synthetic Oligonucleotide
ctctggtccttact

SEQ ID NO: 1362 - DNA, 16 bp, Artificial Sequence
  Synthetic Oligonucleotide
gtctctggtccttact

SEQ ID NO: 1363 - DNA, 14 bp, Artificial Sequence
  Synthetic Oligonucleotide
tctctggtccttac

SEQ ID NO: 1364 - DNA, 14 bp, Artificial Sequence
  Synthetic Oligonucleotide
cctctgactgggaa

SEQ ID NO: 1365 - DNA, 14 bp, Artificial Sequence
  Synthetic Oligonucleotide
catagcgcctctga

SEQ ID NO: 1366 - DNA, 14 bp, Artificial Sequence
  Synthetic Oligonucleotide
caggtagctataat

SEQ ID NO: 1367 - DNA, 12 bp, Artificial Sequence
  Synthetic Oligonucleotide
caggtagctata

SEQ ID NO: 1368 - DNA, 14 bp, Artificial Sequence
  Synthetic Oligonucleotide
tcatcttgtgaaac

SEQ ID NO: 1369 - DNA, 12 bp, Artificial Sequence
  Synthetic Oligonucleotide
catcttgtgaaa

SEQ ID NO: 1370 - DNA, 14 bp, Artificial Sequence
  Synthetic Oligonucleotide
gtttcaaacatcat

SEQ ID NO: 1371 - DNA, 14 bp, Artificial Sequence
  Synthetic Oligonucleotide
tagtttcaaacatc

SEQ ID NO: 1372 - DNA, 12 bp, Artificial Sequence
  Synthetic Oligonucleotide
agtttcaaacat

SEQ ID NO: 1373 - DNA, 12 bp, Artificial Sequence
  Synthetic Oligonucleotide
gaatagtttcaa

SEQ ID NO: 1374 - DNA, 14 bp, Artificial Sequence
  Synthetic Oligonucleotide
cattggaatagttt

SEQ ID NO: 1375 - DNA, 14 bp, Artificial Sequence
  Synthetic Oligonucleotide
cactgaacattgga

SEQ ID NO: 1376 - DNA, 12 bp, Artificial Sequence
  Synthetic Oligonucleotide
actgaacattgg

SEQ ID NO: 1377 - DNA, 14 bp, Artificial Sequence
  Synthetic Oligonucleotide
ccgccactgaacat

SEQ ID NO: 1378 - DNA, 14 bp, Artificial Sequence
  Synthetic Oligonucleotide
cagaccacaaactg

SEQ ID NO: 1379 - DNA, 12 bp, Artificial Sequence
  Synthetic Oligonucleotide
agaccacaaact

SEQ ID NO: 1380 - DNA, 14 bp, Artificial Sequence
  Synthetic Oligonucleotide
ctggcagaccacaa

SEQ ID NO: 1381 - DNA, 14 bp, Artificial Sequence
  Synthetic Oligonucleotide
agctggcagaccac

SEQ ID NO: 1382 - DNA, 14 bp, Artificial Sequence
  Synthetic Oligonucleotide
acctttagctggca

SEQ ID NO: 1383 - DNA, 14 bp, Artificial Sequence
  Synthetic Oligonucleotide
tcttcacctttagc

SEQ ID NO: 1384 - DNA, 12 bp, Artificial Sequence
  Synthetic Oligonucleotide
tcaaagtacatg

SEQ ID NO: 1385 - DNA, 14 bp, Artificial Sequence
  Synthetic Oligonucleotide
gaactcaaagtaca

SEQ ID NO: 1386 - DNA, 12 bp, Artificial Sequence
  Synthetic Oligonucleotide
ggaactcaaagt

SEQ ID NO: 1387 - DNA, 14 bp, Artificial Sequence
  Synthetic Oligonucleotide
agggaactcaaagt

SEQ ID NO: 1388 - DNA, 12 bp, Artificial Sequence
  Synthetic Oligonucleotide
gggaactcaaag

SEQ ID NO: 1389 - DNA, 14 bp, Artificial Sequence
  Synthetic Oligonucleotide
gctgagggaactca

SEQ ID NO: 1390 - DNA, 14 bp, Artificial Sequence
  Synthetic Oligonucleotide
tcaccacacacagg

SEQ ID NO: 1391 - DNA, 14 bp, Artificial Sequence
  Synthetic Oligonucleotide
gaactctactttga

SEQ ID NO: 1392 - DNA, 12 bp, Artificial Sequence
  Synthetic Oligonucleotide
gaagaactctac

SEQ ID NO: 1393 - DNA, 14 bp, Artificial Sequence
  Synthetic Oligonucleotide
gtggaagaactcta

SEQ ID NO: 1394 - DNA, 12 bp, Artificial Sequence
  Synthetic Oligonucleotide
tggaagaactct

SEQ ID NO: 1395 - DNA, 14 bp, Artificial Sequence
  Synthetic Oligonucleotide
tgtttgtggaagaa

SEQ ID NO: 1396 - DNA, 14 bp, Artificial Sequence
  Synthetic Oligonucleotide
catcttgttctgtt

SEQ ID NO: 1397 - DNA, 14 bp, Artificial Sequence
  Synthetic Oligonucleotide
agtgaaacattttg

SEQ ID NO: 1398 - DNA, 12 bp, Artificial Sequence
  Synthetic Oligonucleotide
ttacccaaaagt

SEQ ID NO: 1399 - DNA, 14 bp, Artificial Sequence
  Synthetic Oligonucleotide
tatttacccaaaag

SEQ ID NO: 1400 - DNA, 14 bp, Artificial Sequence
  Synthetic Oligonucleotide
gtatttacccaaaa

SEQ ID NO: 1401 - DNA, 12 bp, Artificial Sequence
  Synthetic Oligonucleotide
tatttacccaaa

SEQ ID NO: 1402 - DNA, 14 bp, Artificial Sequence
  Synthetic Oligonucleotide
tcctggtatgaaga

SEQ ID NO: 1403 - DNA, 12 bp, Artificial Sequence
  Synthetic Oligonucleotide
cctggtatgaag

SEQ ID NO: 1404 - DNA, 12 bp, Artificial Sequence
  Synthetic Oligonucleotide
ggtcctggtatg

SEQ ID NO: 1405 - DNA, 14 bp, Artificial Sequence
  Synthetic Oligonucleotide
ttcctctggtcctg

SEQ ID NO: 1406 - DNA, 14 bp, Artificial Sequence
  Synthetic Oligonucleotide
aggtttcctctggt

SEQ ID NO: 1407 - DNA, 12 bp, Artificial Sequence
  Synthetic Oligonucleotide
ggtttcctctgg

SEQ ID NO: 1408 - DNA, 14 bp, Artificial Sequence
  Synthetic Oligonucleotide
ttttctgaggtttc

SEQ ID NO: 1409 - DNA, 14 bp, Artificial Sequence
  Synthetic Oligonucleotide
agacttccattttc

SEQ ID NO: 1410 - DNA, 12 bp, Artificial Sequence
  Synthetic Oligonucleotide
agacttccattt

SEQ ID NO: 1411 - DNA, 14 bp, Artificial Sequence
  Synthetic Oligonucleotide
caaatgctatcgat

SEQ ID NO: 1412 - DNA, 14 bp, Artificial Sequence
  Synthetic Oligonucleotide
gcacgctctatact

SEQ ID NO: 1413 - DNA, 12 bp, Artificial Sequence
  Synthetic Oligonucleotide
cacgctctatac

SEQ ID NO: 1414 - DNA, 14 bp, Artificial Sequence
  Synthetic Oligonucleotide
tccttgtcattatc

SEQ ID NO: 1415 - DNA, 14 bp, Artificial Sequence
  Synthetic Oligonucleotide
gctttgtcaagatc

SEQ ID NO: 1416 - DNA, 14 bp, Artificial Sequence
  Synthetic Oligonucleotide
tgctttgtcaagat

SEQ ID NO: 1417 - DNA, 14 bp, Artificial Sequence
  Synthetic Oligonucleotide
aagtatcggttggc

SEQ ID NO: 1418 - DNA, 12 bp, Artificial Sequence
  Synthetic Oligonucleotide
agtatcggttgg

SEQ ID NO: 1419 - DNA, 14 bp, Artificial Sequence
  Synthetic Oligonucleotide
ttaaaatttggaga

SEQ ID NO: 1420 - DNA, 14 bp, Artificial Sequence
  Synthetic Oligonucleotide
ccttaaaatttgga

SEQ ID NO: 1421 - DNA, 12 bp, Artificial Sequence
  Synthetic Oligonucleotide
cttaaaatttgg

SEQ ID NO: 1422 - DNA, 14 bp, Artificial Sequence
  Synthetic Oligonucleotide
tctactgtttttgt

SEQ ID NO: 1423 - DNA, 14 bp, Artificial Sequence
  Synthetic Oligonucleotide
ggctcctctactgt

SEQ ID NO: 1424 - DNA, 15 bp, Artificial Sequence
  Synthetic Oligonucleotide
agcctctggatttga

SEQ ID NO: 1425 - DNA, 14 bp, Artificial Sequence
  Synthetic Oligonucleotide
agcctctggatttg

SEQ ID NO: 1426 - DNA, 15 bp, Artificial Sequence
  Synthetic Oligonucleotide
tagcctctggatttg

SEQ ID NO: 1427 - DNA, 14 bp, Artificial Sequence
  Synthetic Oligonucleotide
tagcctctggattt

SEQ ID NO: 1428 - DNA, 16 bp, Artificial Sequence
  Synthetic Oligonucleotide
gctagcctctggattt

SEQ ID NO: 1429 - DNA, 15 bp, Artificial Sequence
  Synthetic Oligonucleotide
ctagcctctggattt

SEQ ID NO: 1430 - DNA, 15 bp, Artificial Sequence
  Synthetic Oligonucleotide
gctagcctctggatt

SEQ ID NO: 1431 - DNA, 14 bp, Artificial Sequence
  Synthetic Oligonucleotide
ctagcctctggatt

SEQ ID NO: 1432 - DNA, 13 bp, Artificial Sequence
  Synthetic Oligonucleotide
tagcctctggatt

SEQ ID NO: 1433 - DNA, 15 bp, Artificial Sequence
  Synthetic Oligonucleotide
tgctagcctctggat

SEQ ID NO: 1434 - DNA, 12 bp, Artificial Sequence
  Synthetic Oligonucleotide
tagcctctggat

SEQ ID NO: 1435 - DNA, 15 bp, Artificial Sequence
  Synthetic Oligonucleotide
ctgctagcctctgga

SEQ ID NO: 1436 - DNA, 15 bp, Artificial Sequence
  Synthetic Oligonucleotide
actgctagcctctgg

SEQ ID NO: 1437 - DNA, 15 bp, Artificial Sequence
  Synthetic Oligonucleotide
aactgctagcctctg

SEQ ID NO: 1438 - DNA, 15 bp, Artificial Sequence
  Synthetic Oligonucleotide
gaactgctagcctct

SEQ ID NO: 1439 - DNA, 15 bp, Artificial Sequence
  Synthetic Oligonucleotide
tgaactgctagcctc

SEQ ID NO: 1440 - DNA, 15 bp, Artificial Sequence
  Synthetic Oligonucleotide
ttgaactgctagcct

SEQ ID NO: 1441 - DNA, 14 bp, Artificial Sequence
  Synthetic Oligonucleotide
tgaactgctagcct

SEQ ID NO: 1442 - DNA, 14 bp, Artificial Sequence
  Synthetic Oligonucleotide
agttgaactgctag

SEQ ID NO: 1443 - DNA, 12 bp, Artificial Sequence
  Synthetic Oligonucleotide
gttgaactgcta

SEQ ID NO: 1444 - DNA, 12 bp, Artificial Sequence
  Synthetic Oligonucleotide
gaagttgaactg

SEQ ID NO: 1445 - DNA, 14 bp, Artificial Sequence
  Synthetic Oligonucleotide
acagaagttgaact

SEQ ID NO: 1446 - DNA, 14 bp, Artificial Sequence
  Synthetic Oligonucleotide
tcattgtcactaac

SEQ ID NO: 1447 - DNA, 12 bp, Artificial Sequence
  Synthetic Oligonucleotide
cattgtcactaa

SEQ ID NO: 1448 - DNA, 12 bp, Artificial Sequence
  Synthetic Oligonucleotide
tcaggttcattg

SEQ ID NO: 1449 - DNA, 14 bp, Artificial Sequence
  Synthetic Oligonucleotide
atgatcaggttcat

SEQ ID NO: 1450 - DNA, 14 bp, Artificial Sequence
  Synthetic Oligonucleotide
tataatgatcaggt

SEQ ID NO: 1451 - DNA, 12 bp, Artificial Sequence
  Synthetic Oligonucleotide
ataatgatcagg

SEQ ID NO: 1452 - DNA, 14 bp, Artificial Sequence
  Synthetic Oligonucleotide
tggtgtcagaatat

SEQ ID NO: 1453 - DNA, 14 bp, Artificial Sequence
  Synthetic Oligonucleotide
tcagtggtgtcaga

SEQ ID NO: 1454 - DNA, 14 bp, Artificial Sequence
  Synthetic Oligonucleotide
ctctggatcagagt

SEQ ID NO: 1455 - DNA, 14 bp, Artificial Sequence
  Synthetic Oligonucleotide
aaggttcattctct

SEQ ID NO: 1456 - DNA, 14 bp, Artificial Sequence
  Synthetic Oligonucleotide
ttcatcaaaaggtt

SEQ ID NO: 1457 - DNA, 14 bp, Artificial Sequence
  Synthetic Oligonucleotide
cttcatcaaaaggt

SEQ ID NO: 1458 - DNA, 12 bp, Artificial Sequence
  Synthetic Oligonucleotide
cttcatcaaaag

SEQ ID NO: 1459 - DNA, 14 bp, Artificial Sequence
  Synthetic Oligonucleotide
atgctgatcttcat

SEQ ID NO: 1460 - DNA, 14 bp, Artificial Sequence
  Synthetic Oligonucleotide
ttttgtaatttgtg

SEQ ID NO: 1461 - DNA, 14 bp, Artificial Sequence
  Synthetic Oligonucleotide
tcagacttttgtaa

SEQ ID NO: 1462 - DNA, 14 bp, Artificial Sequence
  Synthetic Oligonucleotide
tgtcctattgccat

SEQ ID NO: 1463 - DNA, 14 bp, Artificial Sequence
  Synthetic Oligonucleotide
tctgacacaatgtc

SEQ ID NO: 1464 - DNA, 12 bp, Artificial Sequence
  Synthetic Oligonucleotide
ctgacacaatgt

SEQ ID NO: 1465 - DNA, 14 bp, Artificial Sequence
  Synthetic Oligonucleotide
tgttcctataactg

SEQ ID NO: 1466 - DNA, 12 bp, Artificial Sequence
  Synthetic Oligonucleotide
gttcctataact

SEQ ID NO: 1467 - DNA, 14 bp, Artificial Sequence
  Synthetic Oligonucleotide
aagattggtcagga

SEQ ID NO: 1468 - DNA, 12 bp, Artificial Sequence
  Synthetic Oligonucleotide
agattggtcagg

SEQ ID NO: 1469 - DNA, 14 bp, Artificial Sequence
  Synthetic Oligonucleotide
gtgtcaaaaccctg

SEQ ID NO: 1470 - DNA, 12 bp, Artificial Sequence
  Synthetic Oligonucleotide
agctacacaacc

SEQ ID NO: 1471 - DNA, 14 bp, Artificial Sequence
  Synthetic Oligonucleotide
cacagctacacaac

SEQ ID NO: 1472 - DNA, 12 bp, Artificial Sequence
  Synthetic Oligonucleotide
acagctacacaa

SEQ ID NO: 1473 - DNA, 14 bp, Artificial Sequence
  Synthetic Oligonucleotide
tatatacatgacac

SEQ ID NO: 1474 - DNA, 12 bp, Artificial Sequence
  Synthetic Oligonucleotide
atatacatgaca

SEQ ID NO: 1475 - DNA, 14 bp, Artificial Sequence
  Synthetic Oligonucleotide
aattttaaatgtcc

SEQ ID NO: 1476 - DNA, 12 bp, Artificial Sequence
  Synthetic Oligonucleotide
attttaaatgtc

SEQ ID NO: 1477 - DNA, 12 bp, Artificial Sequence
  Synthetic Oligonucleotide
tcctaattgaat

SEQ ID NO: 1478 - DNA, 12 bp, Artificial Sequence
  Synthetic Oligonucleotide
aaagtgccatct

SEQ ID NO: 1479 - DNA, 14 bp, Artificial Sequence
  Synthetic Oligonucleotide
tttataaaactgga

SEQ ID NO: 1480 - DNA, 12 bp, Artificial Sequence
  Synthetic Oligonucleotide
ttataaaactgg

SEQ ID NO: 1481 - DNA, 14 bp, Artificial Sequence
  Synthetic Oligonucleotide
tgcaaacttatctg

SEQ ID NO: 1482 - DNA, 12 bp, Artificial Sequence
  Synthetic Oligonucleotide
gcaaacttatct

SEQ ID NO: 1483 - DNA, 12 bp, Artificial Sequence
  Synthetic Oligonucleotide
agccaactgcaa

SEQ ID NO: 1484 - DNA, 14 bp, Artificial Sequence
  Synthetic Oligonucleotide
cttagccaactgca

SEQ ID NO: 1485 - DNA, 12 bp, Artificial Sequence
  Synthetic Oligonucleotide
ttagccaactgc

SEQ ID NO: 1486 - DNA, 14 bp, Artificial Sequence
  Synthetic Oligonucleotide
taaatcattgtcaa

SEQ ID NO: 1487 - DNA, 14 bp, Artificial Sequence
  Synthetic Oligonucleotide
gcactggccttgat

SEQ ID NO: 1488 - DNA, 12 bp, Artificial Sequence
  Synthetic Oligonucleotide
cactggccttga

SEQ ID NO: 1489 - DNA, 12 bp, Artificial Sequence
  Synthetic Oligonucleotide
ttagcactggcc

SEQ ID NO: 1490 - DNA, 12 bp, Artificial Sequence
  Synthetic Oligonucleotide
tgtgtaaggtca

SEQ ID NO: 1491 - DNA, 12 bp, Artificial Sequence
  Synthetic Oligonucleotide
gttaatgacatt

SEQ ID NO: 1492 - DNA, 12 bp, Artificial Sequence
  Synthetic Oligonucleotide
gacaatttctac

SEQ ID NO: 1493 - DNA, 12 bp, Artificial Sequence
  Synthetic Oligonucleotide
aacactgcacat

SEQ ID NO: 1494 - DNA, 14 bp, Artificial Sequence
  Synthetic Oligonucleotide
taggtcaagtctaa

SEQ ID NO: 1495 - DNA, 14 bp, Artificial Sequence
  Synthetic Oligonucleotide
tataggtcaagtct

SEQ ID NO: 1496 - DNA, 14 bp, Artificial Sequence
  Synthetic Oligonucleotide
tttggataaatata

SEQ ID NO: 1497 - DNA, 14 bp, Artificial Sequence
  Synthetic Oligonucleotide
tgggacttcacacc

SEQ ID NO: 1498 - DNA, 12 bp, Artificial Sequence
  Synthetic Oligonucleotide
accacagctagt

SEQ ID NO: 1499 - DNA, 12 bp, Artificial Sequence
  Synthetic Oligonucleotide
gggacttcacac

SEQ ID NO: 1500 - DNA, 14 bp, Artificial Sequence
  Synthetic Oligonucleotide
ccaaaaaccttact

SEQ ID NO: 1501 - DNA, 12 bp, Artificial Sequence
  Synthetic Oligonucleotide
gtggcaaccaca

SEQ ID NO: 1502 - DNA, 12 bp, Artificial Sequence
  Synthetic Oligonucleotide
aaggcttaaagt

SEQ ID NO: 1503 - DNA, 12 bp, Artificial Sequence
  Synthetic Oligonucleotide
aggacttgggat

SEQ ID NO: 1504 - DNA, 12 bp, Artificial Sequence
  Synthetic Oligonucleotide
gggaatcagagc

SEQ ID NO: 1505 - DNA, 12 bp, Artificial Sequence
  Synthetic Oligonucleotide
atttgatgctgc

SEQ ID NO: 1506 - DNA, 12 bp, Artificial Sequence
  Synthetic Oligonucleotide
ttccaatgacta

SEQ ID NO: 1507 - DNA, 12 bp, Artificial Sequence
  Synthetic Oligonucleotide
atcaacagctgc

SEQ ID NO: 1508 - DNA, 14 bp, Artificial Sequence
  Synthetic Oligonucleotide
gattgcaagttccg

SEQ ID NO: 1509 - DNA, 12 bp, Artificial Sequence
  Synthetic Oligonucleotide
tgcttggaagga

SEQ ID NO: 1510 - DNA, 14 bp, Artificial Sequence
  Synthetic Oligonucleotide
ctgctgcacatcca

SEQ ID NO: 1511 - DNA, 12 bp, Artificial Sequence
  Synthetic Oligonucleotide
cacattaacagt

SEQ ID NO: 1512 - DNA, 12 bp, Artificial Sequence
  Synthetic Oligonucleotide
agttgaaatttc

SEQ ID NO: 1513 - DNA, 12 bp, Artificial Sequence
  Synthetic Oligonucleotide
accctcattcag

SEQ ID NO: 1514 - DNA, 12 bp, Artificial Sequence
  Synthetic Oligonucleotide
agaatgagactt

SEQ ID NO: 1515 - DNA, 12 bp, Artificial Sequence
  Synthetic Oligonucleotide
gtaaatcctaag

SEQ ID NO: 1516 - DNA, 12 bp, Artificial Sequence
  Synthetic Oligonucleotide
taaatataggtc

SEQ ID NO: 1517 - DNA, 12 bp, Artificial Sequence
  Synthetic Oligonucleotide
aatgccttatta

SEQ ID NO: 1518 - DNA, 14 bp, Artificial Sequence
  Synthetic Oligonucleotide
caccttaaaatttg

SEQ ID NO: 1519 - DNA, 12 bp, Artificial Sequence
  Synthetic Oligonucleotide
gtgtacagattt

SEQ ID NO: 1520 - DNA, 12 bp, Artificial Sequence
  Synthetic Oligonucleotide
ctttcagtcata

SEQ ID NO: 1521 - DNA, 12 bp, Artificial Sequence
  Synthetic Oligonucleotide
gggcatatcaaa

SEQ ID NO: 1522 - DNA, 12 bp, Artificial Sequence
  Synthetic Oligonucleotide
tgaggcattatc

SEQ ID NO: 1523 - skipped

SEQ ID NO: 1524 - DNA, 19 bp, Artificial Sequence
  Primer
cgtgggctccagcattcta

SEQ ID NO: 1525 - DNA, 21 bp, Artificial Sequence
  Primer
agtcatttctgcctttgcgtc

SEQ ID NO: 1526 - DNA, 22 bp, Artificial Sequence
  Probe
ccaatggtcgggcactgctcaa

SEQ ID NO: 1527 - DNA, 30 bp, Artificial Sequence
  Primer
gaaaatagacttcctgaataactatgcatt

SEQ ID NO: 1528 - DNA, 18 bp, Artificial Sequence
  Primer
actcgcttgccagcttgc

SEQ ID NO: 1529 - DNA, 23 bp, Artificial Sequence
  Probe
tttctgagtccccgtgcccaaca

SEQ ID NO: 1530 - DNA, 20 bp, Artificial Sequence
  Primer
tgagccttgccaccttctct

SEQ ID NO: 1531 - DNA, 15 bp, Artificial Sequence
  Primer
gcgcaccccagccaa

SEQ ID NO: 1532 - DNA, 29 bp, Artificial Sequence
  Probe
agaggagcttcttttccctctacctgggc

SEQ ID NO: 1533 - DNA, 20 bp, Artificial Sequence
  Primer
atttcctgcccctggtacct

SEQ ID NO: 1534 - DNA, 17 bp, Artificial Sequence
  Primer
cgggcccacacctcttg

SEQ ID NO: 1535 - DNA, 26 bp, Artificial Sequence
  Probe
ccacaaagtgcagcaccgcctagtgt

SEQ ID NO: 1536 - DNA, 19 bp, Artificial Sequence
  Primer
gccacaggctcccagacat

SEQ ID NO: 1537 - DNA, 25 bp, Artificial Sequence
  Primer
tccatcctcttgatatctccttttg

SEQ ID NO: 1538 - DNA, 31 bp, Artificial Sequence
  Probe
acagccatcatcaaagagatcgttagcagaa

SEQ ID NO: 1539 - DNA, 24 bp, Artificial Sequence
  Primer
atgacaatcatgttgcagcaattc

SEQ ID NO: 1540 - DNA, 25 bp, Artificial Sequence
  Primer
cgatgcaataaatatgcacaaatca

SEQ ID NO: 1541 - DNA, 28 bp, Artificial Sequence
  Probe
ctgtaaagctggaaagggacggactggt

SEQ ID NO: 1542 - DNA, 14 bp, Artificial Sequence
  Synthetic Oligonucleotide
gtgtgcacacagct

SEQ ID NO: 1543 - DNA, 12 bp, Artificial Sequence
  Synthetic Oligonucleotide
cagcctgggcac

SEQ ID NO: 1544 - DNA, 14 bp, Artificial Sequence
  Synthetic Oligonucleotide
tgctcgaactcctt

SEQ ID NO: 1545 - DNA, 14 bp, Artificial Sequence
  Synthetic Oligonucleotide
gaagtcactggctt

SEQ ID NO: 1546 - DNA, 14 bp, Artificial Sequence
  Synthetic Oligonucleotide
gggaagtcactggc

SEQ ID NO: 1547 - DNA, 14 bp, Artificial Sequence
  Synthetic Oligonucleotide
gttaggcaaagggc

SEQ ID NO: 1548 - DNA, 14 bp, Artificial Sequence
  Synthetic Oligonucleotide
gggctgagtgaccc

SEQ ID NO: 1549 - DNA, 14 bp, Artificial Sequence
  Synthetic Oligonucleotide
atgctagtgcacta

SEQ ID NO: 1550 - DNA, 14 bp, Artificial Sequence
  Synthetic Oligonucleotide
agctcgctacctct

SEQ ID NO: 1551 - DNA, 14 bp, Artificial Sequence
  Synthetic Oligonucleotide
gaggtatcccatct

SEQ ID NO: 1552 - DNA, 14 bp, Artificial Sequence
  Synthetic Oligonucleotide
ggcaacttcaacct

SEQ ID NO: 1553 - DNA, 20 bp, Artificial Sequence
  Synthetic Oligonucleotide
gaagtagccaccaactgtgc

SEQ ID NO: 1554 - DNA, 12 bp, Artificial Sequence
  Synthetic Oligonucleotide
tagccaccaact

SEQ ID NO: 1555-1556 - skipped (2 entries)

SEQ ID NO: 1557 - DNA, 10 bp, Artificial Sequence
  Synthetic Oligonucleotide
agccaccaac

SEQ ID NO: 1558 - DNA, 8 bp, Artificial Sequence
  Synthetic Oligonucleotide
gccaccaa

SEQ ID NO: 1559 - DNA, 13 bp, Artificial Sequence
  Synthetic Oligonucleotide
tagccaccaactg

SEQ ID NO: 1560 - DNA, 12 bp, Artificial Sequence
  Synthetic Oligonucleotide
taccgaacacct

SEQ ID NO: 1561 - DNA, 20 bp, Artificial Sequence
  Synthetic Oligonucleotide
gtccctgaagatgtcaatgc

SEQ ID NO: 1562 - DNA, 20 bp, Artificial Sequence
  Synthetic Oligonucleotide
tgcactttgtggtaccaagg

SEQ ID NO: 1563 - DNA, 14 bp, Artificial Sequence
  Synthetic Oligonucleotide
gcttctccatcata

SEQ ID NO: 1564 - DNA, 14 bp, Artificial Sequence
  Synthetic Oligonucleotide
tgtcttgctgcttt

SEQ ID NO: 1565-1567 - skipped (3 entries)

SEQ ID NO: 1568 - DNA, 20 bp, Artificial Sequence
  Synthetic Oligonucleotide
atggcttctccatcatatcc

SEQ ID NO: 1569 - DNA, 20 bp, Artificial Sequence
  Synthetic Oligonucleotide
cttgggcatgctcgtcagtc

SEQ ID NO: 1570 - DNA, 20 bp, Artificial Sequence
  Synthetic Oligonucleotide
ccttccctgaaggttcctcc

SEQ ID NO: 1571 - DNA, 20 bp, Artificial Sequence
  Synthetic Oligonucleotide
ctgctagcctctggatttga

SEQ ID NO: 1572 - skipped

SEQ ID NO: 1573 - DNA, 14 bp, Artificial Sequence
  Synthetic Oligonucleotide
gaatatctataatg

SEQ ID NO: 1574 - DNA, 12 bp, Artificial Sequence
  Synthetic Oligonucleotide
gtaagcaaggct

SEQ ID NO: 1575 - DNA, 2254 bp, Rattus norvegicus
agagaatggagggacacgtagaggaaggctctgaacttggggagcagaaggtcctgattgataatcctgctgacattctggtcattgccgcgtatttcctgctggtcattggtgttggcttgtggtctatgttcagaaccaatagaggcacagttggtggctacttcttggcaggacggagcatggtgtggtggccggttggagcctctctgttcgccagcaacatcggcagcggtcattttgtgggcctggcggggactggtgcagcaagtggcttggccgtggctggatttgagtggaatgcgctctttgtggtgttgctcctcggctggctcttcgtgcctgtgtatctgaccgccggagtgattaccatgcctcagtacctccgcaagcgctttggtgggcgccgtattcgcctctacctgtccgtgctctcgctttttttgtacattttcaccaagatctcggtggatatgttctccggagcagtattcattcaacaggccctgggctggaacatttacgcttctgtcatcgcactcttgggcatcaccatgatttatactgtgacaggagggctggcggcactgatgtacacagacactgtgcagaccttcgtcattcttgccggggccttcatcctcactggttatgctttccatgaagtgggcgggtactcaggtctcttcgacaaatacctgggagcagtgacttcactgacggtgtccaaggatccagctgttggcaacatctccagcacctgctatcagccgaggcccgactcctatcacctgctgcgtgaccctgtgacaggagggctgccgtggcctgcgctgcttctggggcttaccattgtctcaggctggcactggtgcagtgaccaggtaattgtgcagcgctgcctggctggaaagaatctgactcacatcaaggctggatgcatcctgtgtggttacctgaagctgatgcccatgttcctcatggtcatgccaggcatgattagccgcattctttacccagatgaggtggcctgtgtggtacctgaggtgtgtaagcgggtgtgtggcactgaggtgggctgctctaacatcgcctacccacggcttgttgtgaagctcatgcccaatggtctgcgtggactcatgctggcagtcatgctggccgccctcatgtcttctctagcgtccatctttaacagcagcagcacactcttcaccatggatatctacacacgcctgcggcctcgggcgggtgatagggagctgctgctggttggaaggctttgggtggtgttcattgtggcagtgtccgtggcttggctgccagtggtgcaggcagcacagggcggccagctcttcgattacattcagtctgtctccagctacctggcgcctccagtgtccgctgtctttgtgctggcactctttgtgccccgtgttaatgagaagggtgctttctggggactcattgggggcctgctgatgggcctagctcgtctcatacccgagttcttctttggcacgggcagctgtgtgcgaccctctgcatgcccagccatcttctgccgggtacactacctctacttcgccatcattctcttcttctgctccggcttcctcacactcgcaatctcccggtgcaccgcacccatccctcagaagcatctccaccgcctggttttcagtctccggcacagcaaggaggagcgggaggatctggatgctgaagagttagagggtccagcccctcctcctgtgcagaacgggtgccaggaatgtgcaatggggattgaagaggtccagtccccagctccaggcctgctccgccagtgcttgctctggttctgtgggatgagcaagagtgggtcagggagtcctccacccactaccgaggaggtggctgcaaccaccaggcggctagaggacatcagtgaggatcccagctgggcccgagtagtcaacctcaatgccctgctcatgatgactgtggctgtgttcctctggggcttttatgcataaagtcaagtgtgttggttaccatgagttgcaaccagggcatgtctgagcctcatgaaaagtgagggtgaagaacttgtagtggatcccagaaaagggcaaaaatacggcaggaaggaactggttcccttcctctttacctggggtccagtccatttgattggttgtcacttcccacaagatggtggccaatttgtcatagatgtttgcctatgcaaaaataaagctgcccttctaac

SEQ ID NO: 1576 - DNA, 3300 bp, Mus musculus
tacatcaatggaatttaaatagagtcgtcatataataagggaaacaatgtcccaactggacatcacatggtaccaaacaaaagacccagtaccaggaatgagttaccatcttatgaagtcattaaccatagagagctaatggtagcctcaatcattacaaaagctgttgccaaggttactgggtgctctcataccctgatggtaagaccctatggctgaagatggaacttattgatatccttgaacattgagaaattgagctgtgtgactagaagcttcaccccatcgacgatggtcacagtgctgcaaagtgctatgttcaggaggaaggtatccagccgcctccctcagccacactctgagactcacaccagagacctgctcaaagggcatgcccactggcccacaaatattatgggagcaactgaccactttttgggggtgtatttaaggtccacttcatgaaatgggacccatccctgacactgctaaaatgcctgagaacctgaaactagatagagcaagggctctaggggaaagctcactccagttattctaagggcacagggttatgacgcctaatgacatatcgctggctacatcccttggccagcacatcactgaaacctcaccagaggagcttcttggagtagaaggtgattaacagaactgtccgtgactggatgacttgcagagagtgagagacttgggagcactcagacttcaatgggatgcttgtatctcacccctctgctaaagatgcaggttctatacaggaggtgcaaagattgtaagagtcagagttggaggttgtcttcaggaaagcagagttttgcagacacaacaaagctgatgaaaatctgaactcacagacagtgatagcatgcacaagacagatatctgaactcacagaccgtgataacatggcacaaagacctgcacaaagttcgaaccaaataaaatctgagcatggaaaatgaggtgtgggcacaaagtcccactcctaagtaagaaactacttgcagttgacagctactaggagagagaaatgggttttcttcaatggagagacactgggtgtatcaactgcaccccaaggcaggccacacgctcaggaagagttggccaacacaaaacacactccgtgtttggttttctgtttgcttgggtttgtttttgtgcttttattcttccttcctttctttctttgtttctttgtttctctctctctttctctctttttctctctccctcctcctcttcttctttcttctttttcttcttcttcttcttcttcttctttttcttcttcttcttcttctttttcttcttcttcttcttcttcttcttcttcttcttcttcttcttcttcttcttcttcttcttcttcttcttcttcttctgatcagagaggggaggggatctgggaaaagtttggggagaggaaagaatttgcccaaaatatattgcataaaaactttttaaaaataaatttaaaacaatttttaggatagagcaaagagaaagtagaaaatatttgggttgggaagggcaggagaatgagggaaatgtgatttttttctccctaggttttgtatggcagaagtcagggcatggcatgcgtgacagtcaggctgaggaacatgtatgtcctgctgactgtcagggggtgctatggaggacttgtgcggaggacactgtcagagttggattcggaccttcctaatcaaagttagagggtgtattttcagagaacgcaggaaggaactttgcttggaacactgggtataggatggatcctaaacccaggaaggagtgctcttgaattccaaatggtccagcgccccaggaccagccttcggccttgatagatcctgattcagataaataaagctggagaaggaggctgagacctgggggacttgtcgggtcagtgctcctgaggtaaccattaatccttcccccaggggaatccagggactagccccttgagggacagatggtggagagaatggagcaacacgtagaggcaggctctgaacttggggagcagaaggtcctgattgataatcctgctgacattctggttatcgctgcctatttcctgctggtcattggtgttggcttgtgggtgagacattgaggggggttggatagggaaatgcttctggggcttgagggtaaagatttagggagacctcagagaggagtgggagaaaagggtgcttggatataatgagggagaaacctagatttagtaggcaagccaattttaattctttgtcttcgtaccttctggattgtgcaaaagagactgggggtatcaataggtttttttttaattcaagtgttctaacaagtgctctaagagatgtatcagttcccacgtctgtattatggctgagcagcagcctatatttaaggtcaccaggcaagttaggctgaatctaggcatatctaggttccagtagttgcgctaggattagggcctgggttgttctgagtgtcggggaaggttgggggtaaggaggtgcagtctggggagtccagggctggttaatcttcagcctgaaacaaggctgaggaatgtgttgaggaagctaaggaagtccaaagatgtgccccaatcccagtttccccccacttctgtttcccagtctatgttcagaaccaatagaggcacagttggtggctacttcctggcaggacggaacatggtgtggtggccggtgagaggggctgggggatgggatgggagggaccctggaggagcaccctacctcacccccatttctggccacccaggttggagcctctctgttcgccagcaacatcggcagcggtcattttgtgggcctggcagggactggtgcagcaagtggcttggcggtggctggatttgagtggaatgtgaggtcttcttttctataataatccaccccagtggaaactcctggaaagatcacaacttggggaagctcctggcgtggggatatgaacaagttgggacagcacagtttgctgagggtgggtgggtgttaggttgggctgggagcaaggatcgcgtgctagcttacagcagtagggttcaggcaggtcctgctcctgactttctgtatacgccagcatcagtcctcgtgggccttgaccactctgaaatggggccggcacctcactgatgaagtacctgtctccatgttctttgatgctgtagtctgtgagcaactctaggctgaactgaagttctttgcaaaaacaaggatgggttggaaagatgagggtttgagccttcctgtaaga

The invention claimed is:

1. A compound comprising a short antisense oligonucleotide consisting of 10 to 14 linked nucleosides targeted to SGLT2, wherein said short antisense oligonucleotide comprises at least an eight consecutive nucleobase portion of the nucleobase sequence set forth in SEQ ID NO:281, and the compound is at least 95% complementary to sodium dependent glucose transporter 2 (SGLT2) encoded by SEQ ID NO: 3 as measured over the entire length of the compound.

2. The compound of claim 1, consisting of a single-stranded modified oligonucleotide.

3. The compound of claim 1, wherein the short antisense oligonucleotide is a DNA oligonucleotide.

4. The compound of claim 1, wherein said short antisense oligonucleotide is a RNA oligonucleotide.

5. The compound of claim 1, wherein said short antisense oligonucleotide consists of a nucleobase sequence of SEQ ID ON:281.

6. The compound of claim 1, wherein said short antisense oligonucleotide consists of the nucleobase sequence of SEQ ID NO:281 and comprises:
a gap segment consisting of eight linked deoxynucleosides;
a 5' wing segment consisting of two linked nucleosides;
a 3' wing segment consisting of two linked nucleosides;
wherein the gap segment is positioned between the 5' wing segment and the 3' wing segment, wherein each nucleoside of each wing segment comprises a 2'-O-methoxyethyl modified sugar, wherein each internucleoside linkage of said modified oligonucleotide is a phosphorothioate linkage, and wherein each cytosine of said modified oligonucleotide is a 5-methylcytosine.

7. The compound of claim 1 wherein the short antisense oligonucleotide comprises a 2'-deoxyribonucleotide gap region flanked on each side by a wing, wherein each wing independently comprises 1 to 3 high-affinity modified nucleosides.

8. The compound of claim 7, wherein said high-affinity modified nucleosides are sugar modified nucleosides.

9. The compound of claim 8, wherein at least one of the sugar-modified nucleosides comprises a bridge between the 4' and the 2' position of the sugar.

10. The compound of claim 8, wherein each of said high-affinity modified nucleotides confers a $\Delta T_m$ of 1 to 4 degrees per nucleotide.

11. The compound of claim 8, wherein each of said sugar-modified nucleotides comprises a 2'-substituent group that is other than H or OH.

12. The compound of claim 11, wherein at least one of said sugar-modified nucleotides is a 4' to 2' bridged bicyclic nucleotide.

13. The compound of claim 11, wherein each of the 2'-substituent groups is, independently, alkoxy, substituted alkoxy, or halogen.

14. The compound of claim 13, wherein each of the 2'-substituent groups is $OCH_2CH_2OCH_3$.

15. The compound claim 9, wherein the conformation of each of said sugar-modified nucleotides is, independently, β-D or α-L.

16. The compound claim 11, wherein each of said bridges independently comprises 1 or from 2 to 3 linked groups independently selected from -[C(R$_1$)(R$_2$)]$_n$—, —C(R$_1$)=C(R$_2$)—, —C(R$_1$)=N—, —C(=NR$_1$)—, —C(=O)—, —C(=S)—, —O—, —Si(R$_1$)$_2$—, —S(=O)$_x$— and —N(R$_1$)—;
wherein x is 0, 1, or 2;
n is 1, 2, 3, or 4;
each R$_1$ and R$_2$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and
each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl or a protecting group.

17. The compound of claim 16, wherein each of said bridges is, independently, 4'-CH$_2$-2', 4'-(CH$_2$)$_2$-2', 4'-CH$_2$—O-2', 4'-(CH$_2$)$_2$—O-2', 4'CH$_2$—O—N(R$_1$)-2' and 4'-CH$_2$—N(R$_1$)—O-2'- wherein each R$_1$ is, independently, H, a protecting group or C$_1$-C$_{12}$ alkyl.

18. The compound of claim 7, wherein each of the high-affinity modified nucleosides is independently selected from bicyclic nucleotides or other 2'-modified nucleotides.

19. The compound of claim 18, wherein the 2'-modified nucleotides are selected from halogen, allyl, amino, azido, thio, O-allyl, O—C$_1$-C$_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$) or O—CH$_2$—C(=O)—N(R$_m$)(R$_n$), where each R$_m$, and R$_n$ is, independently, H or substituted or unsubstituted C$_1$-C$_{10}$ alkyl.

20. The compound of claim 19, wherein the 2'-modified nucleotide is a 2'-OCH$_2$CH$_2$OCH$_3$ nucleotide.

21. The compound of claim 7, wherein the short antisense oligonucleotide comprises at least one modified internucleoside linkage.

22. The compound of claim 21, wherein the modified internucleoside linkage is a phosphorothioate linkage.

23. The compound of claim 7, wherein each modified internucleoside linkage is a phosphorothioate internucleoside linkage.

24. The compound of claim 7 that is 10-13 linked nucleosides in length.

25. The compound of claim 7 that is 10-12 linked nucleosides in length.

26. The compound of claim 7 that is 10-11 linked nucleosides in length.

27. The compound of claim 7 that is 10 linked nucleosides in length.

28. The compound of claim 7 that is 11 linked nucleosides in length.

29. The compound of claim 7 that is 12 linked nucleosides in length.

30. The compound of claim 7 that is 13 linked nucleosides in length.

31. The compound of claim 7 that is 14 linked nucleosides in length.

32. The compound of claim 7, having a motif selected from 1-12-1; 2-10-2; 1-10-1; 1-10-2; 3-8-3; 2-8-2; 1-8-1; and 3-6-3, wherein, the first number represents the number of linked nucleosides in the 5'-wing, the second number represents the number of linked nucleosides in the gap, and the third number represents the number of linked nucleosides in the 3' wing.

33. The compound of claim 32 wherein the motif is selected from 1-10-1; 2-10-2; and 1-9-2.

34. The compound of claim 7 having a motif selected from 1-1-10-2, 1-1-8-2, 1-1-6-3, and 1-2-8-2, wherein the first number represents the number of linked nucleosides in a first 5' wing, the second number represents the number of linked nucleosides in a second 5' wing, the third number represents the number of linked nucleosides in the gap, and the fourth number represents the number of linked nucleosides in the 3' wing.

35. The compound of claim 7 having a motif selected from 2-10-1-1, 2-8-1-1, 3-6-1-1, and 2-8-2-1, wherein the first number represents the number of linked nucleosides in the 5' wing, the second number represents the number of linked nucleosides in the gap, the third number represents the number of linked nucleosides in a first 3' wing, and the fourth number represents the number of linked nucleosides in a second 3' wing.

36. The compound of claim 7 having a motif selected from 1-1-8-1-1; 2-1-6-1-1; and 1-2-8-2-1, wherein the first number represents the number of linked nucleosides in a first 5' wing, the second number represents the number of linked nucleosides in a second 5' wing, the third number represents the number of linked nucleosides in the gap, the fourth number represents the number of linked nucleosides in a first 3' wing and the fifth number represents the number of linked nucleosides in a second 3' wing.

37. A composition comprising a compound of claim 1 or a pharmaceutically acceptable salt thereof and a pharmaceutically acceptable carrier or diluent.

38. A method of treating a condition or disease associated with SGLT2 expression or overexpression in a mammal in need thereof, comprising administering to said mammal an effective amount of said short antisense oligonucleotide of claim 1.

39. The method of claim 38, wherein the disease is a metabolic disorder.

40. The method of claim 39, wherein the metabolic disorder is hyperglycemia, prediabetes, diabetes (type I and type II), obesity, insulin resistance, metabolic syndrome or any combination thereof.

41. A method of decreasing glucose levels, insulin resistance, HbA1c or any combination thereof in a human by administering the compound of claim 1.

42. A composition comprising a compound of claim 6 or a pharmaceutically acceptable salt thereof and a pharmaceutically acceptable carrier or diluent.

43. A method of treating a condition or disease associated with SGLT2 expression or overexpression in a mammal in need thereof, comprising administering to said mammal an effective amount of said short antisense oligonucleotide of claim 6.

44. The method of claim 43, wherein the disease is a metabolic disorder.

45. The method of claim 44, wherein the metabolic disorder is hyperglycemia, prediabetes, diabetes (type I and type II), obesity, insulin resistance, metabolic syndrome or any combination thereof.

46. A method of decreasing glucose levels, insulin resistance, HbA1c or any combination thereof in a human by administering the compound of claim 6.

* * * * *